United States Patent
Patron et al.

(10) Patent No.: US 12,286,661 B2
(45) Date of Patent: *Apr. 29, 2025

(54) METHODS FOR MAKING HIGH INTENSITY SWEETENERS

(71) Applicant: Firmenich Incorporated, Plainsboro, NJ (US)

(72) Inventors: Andrew P. Patron, San Marcos, CA (US); Chris Edano Noriega, San Diego, CA (US); Rama Rao Manam, San Diego, CA (US); Justin Colquitt, San Diego, CA (US); Nathan Faber, San Diego, CA (US); Helge Zieler, Del Mar, CA (US); Justin Stege, San Diego, CA (US); Daniel K. Olson, San Diego, CA (US)

(73) Assignee: Firmenich Incorporated, Plainsboro, NJ (US)

( * ) Notice: Subject to any disclaimer, the term of this patent is extended or adjusted under 35 U.S.C. 154(b) by 154 days.

This patent is subject to a terminal disclaimer.

(21) Appl. No.: 17/291,945

(22) PCT Filed: Nov. 1, 2019

(86) PCT No.: PCT/US2019/059498
§ 371 (c)(1),
(2) Date: May 6, 2021

(87) PCT Pub. No.: WO2020/096907
PCT Pub. Date: May 14, 2020

(65) Prior Publication Data
US 2024/0218402 A1    Jul. 4, 2024

Related U.S. Application Data

(60) Provisional application No. 62/757,141, filed on Nov. 7, 2018.

(51) Int. Cl.
| | | |
|---|---|---|
| C12N 9/14 | (2006.01) | |
| C12N 9/10 | (2006.01) | |
| C12N 9/26 | (2006.01) | |
| C12N 9/42 | (2006.01) | |
| C12N 15/52 | (2006.01) | |
| C12P 7/22 | (2006.01) | |

(52) U.S. Cl.
CPC ............ *C12P 7/22* (2013.01); *C12N 9/1051* (2013.01); *C12N 9/1074* (2013.01); *C12N 9/2411* (2013.01); *C12N 9/2437* (2013.01); *C12N 15/52* (2013.01); *C12Y 204/01005* (2013.01); *C12Y 204/01019* (2013.01); *C12Y 302/01004* (2013.01)

(58) Field of Classification Search
CPC .................................. C12N 9/14; C12P 19/18
See application file for complete search history.

(56) References Cited

U.S. PATENT DOCUMENTS

| | | |
|---|---|---|
| 6,468,576 B1 | 10/2002 | Sher et al. |
| 7,659,097 B2 | 2/2010 | Renninger et al. |
| 8,236,512 B1 | 8/2012 | Zhao et al. |
| 8,357,527 B2 | 1/2013 | Ubersax |
| 8,367,395 B2 | 2/2013 | Bailey et al. |
| 8,415,136 B1 | 4/2013 | Gardner et al. |
| 8,470,568 B2 | 6/2013 | Walker et al. |
| 8,481,286 B2 | 7/2013 | Julien et al. |
| 8,519,204 B2 | 8/2013 | Ohler et al. |
| 8,586,814 B2 | 11/2013 | Fisher et al. |
| 8,603,800 B2 | 12/2013 | Gardner et al. |
| 8,609,371 B2 | 12/2013 | Julien et al. |
| 8,753,842 B2 | 6/2014 | Julien et al. |
| 8,859,261 B2 | 10/2014 | Gardner et al. |
| 9,200,296 B2 | 12/2015 | Renninger et al. |
| 9,410,214 B2 | 8/2016 | Hawkins et al. |
| 9,540,662 B2 | 1/2017 | Walker et al. |
| 11,060,124 B2 | 7/2021 | Patron et al. |
| 11,758,933 B2 | 9/2023 | Patron et al. |
| 2005/0084506 A1 | 4/2005 | Tachdjian et al. |
| 2006/0228454 A1 | 10/2006 | Ackill et al. |
| 2006/0263411 A1 | 11/2006 | Tachdjian et al. |
| 2007/0116690 A1 | 5/2007 | Yang et al. |
| 2009/0111834 A1 | 4/2009 | Tachdjian et al. |
| 2009/0137014 A1 | 5/2009 | Tsuruta et al. |
| 2009/0220662 A1 | 9/2009 | Tachdjian et al. |

(Continued)

FOREIGN PATENT DOCUMENTS

| | | |
|---|---|---|
| CN | 105039274 | 11/2015 |
| EP | 2 783 009 B1 | 4/2016 |

(Continued)

OTHER PUBLICATIONS

US 8,486,659 B2, 07/2013, Julien et al. (withdrawn)
Ager et al., 1998, Commercial, synthetic nonnutritive sweeteners, Angew. Chem. Int. Ed. 37:1802-1817.
Akihisa et al., 2007, Cucurbitane glycosides from the fruits of siraitia grosvenorii and their inhibitory effects on Epstein-Barr virus activation, J. Nat. Prod., 70:783-788.
Altschul et al., 1996, [27] Local Alignment Statistics, Methods in Enzymology, 266:460-480.
Altschul et al., 1997, Gapped BLAST and PSI-BLAST: a new generation of protein database search programs, Nucleic Acids Res., 25(17):3389-3402.

(Continued)

*Primary Examiner* — Tekchand Saidha
(74) *Attorney, Agent, or Firm* — Knobbe, Martens, Olson & Bear, LLP

(57) ABSTRACT

Provided herein include methods of making mogroside compounds, e.g., Compound 1, compositions (for example, host cells) for making mogroside compounds, and the mogroside compounds made by the methods and compositions disclosed herein, compositions made by the methods (for example, cell lysates), and recombinant cells comprising the mogroside compounds (e.g., Compound 1).

20 Claims, 51 Drawing Sheets

Specification includes a Sequence Listing.

(56) References Cited

U.S. PATENT DOCUMENTS

| | | | |
|---|---|---|---|
| 2010/0151519 A1 | 6/2010 | Julien et al. | |
| 2010/0151555 A1 | 6/2010 | Julien et al. | |
| 2011/0027413 A1 | 2/2011 | Jia | |
| 2012/0201763 A1 | 8/2012 | Tachdjian et al. | |
| 2012/0226047 A1 | 9/2012 | Shigemura et al. | |
| 2014/0170286 A1 | 6/2014 | Jia | |
| 2015/0064743 A1 | 3/2015 | Liu et al. | |
| 2015/0093339 A1 | 4/2015 | Tachdjian et al. | |
| 2015/0225754 A1 | 8/2015 | Tange et al. | |
| 2015/0320095 A1 | 11/2015 | Jia | |
| 2017/0029458 A1 | 2/2017 | Siems et al. | |
| 2017/0105432 A1 | 4/2017 | Karanewsky et al. | |
| 2017/0119032 A1 | 5/2017 | Patron et al. | |
| 2017/0145429 A1 | 5/2017 | Walker et al. | |
| 2017/0283844 A1 | 10/2017 | Itkin et al. | |
| 2017/0354175 A1 | 12/2017 | Karanewsky et al. | |
| 2018/0014565 A1 | 1/2018 | Ahmet et al. | |
| 2018/0020707 A1 | 1/2018 | Ahmet et al. | |
| 2018/0020709 A1 | 1/2018 | Markosyan | |
| 2018/0086751 A1 | 3/2018 | Karanewsky et al. | |
| 2020/0178574 A1 | 6/2020 | Prakash et al. | |
| 2021/0324439 A1 | 10/2021 | Patron et al. | |
| 2024/0065302 A1 | 2/2024 | Manam | |
| 2024/0090547 A1 | 3/2024 | Manam | |
| 2024/0108040 A1 | 4/2024 | Patron et al. | |
| 2024/0188613 A1 | 6/2024 | Manam | |
| 2024/0218402 A1* | 7/2024 | Patron | C12N 9/14 |
| 2024/0218414 A1 | 7/2024 | Patron et al. | |
| 2024/0240222 A1 | 7/2024 | Noriega | |

FOREIGN PATENT DOCUMENTS

| | | |
|---|---|---|
| WO | WO 99/57250 | 11/1999 |
| WO | WO 05/015158 | 2/2005 |
| WO | WO 05/041684 | 5/2005 |
| WO | WO 06/084186 | 8/2006 |
| WO | WO 06/138512 | 12/2006 |
| WO | WO 07/124152 | 11/2007 |
| WO | WO 08/154221 | 12/2008 |
| WO | WO 09/023975 | 2/2009 |
| WO | WO 09/100333 | 8/2009 |
| WO | WO 09/111447 | 9/2009 |
| WO | WO 10/014666 | 2/2010 |
| WO | WO 10/014813 | 2/2010 |
| WO | WO 11/112892 | 9/2011 |
| WO | WO 11/123693 | 10/2011 |
| WO | WO 12/021837 | 2/2012 |
| WO | WO 12/061698 | 5/2012 |
| WO | WO 12/103074 | 8/2012 |
| WO | WO 13/025560 | 2/2013 |
| WO | WO 13/076577 | 5/2013 |
| WO | WO 13/096420 | 6/2013 |
| WO | WO 14/025706 | 2/2014 |
| WO | WO 14/027118 | 2/2014 |
| WO | WO 14/086842 | 6/2014 |
| WO | WO 14/130513 | 8/2014 |
| WO | WO 14/140634 | 9/2014 |
| WO | WO 14/146089 | 9/2014 |
| WO | WO 14/130582 | 10/2014 |
| WO | WO 14/086842 A9 | 6/2015 |
| WO | WO 15/082012 | 6/2015 |
| WO | WO 15/168779 | 11/2015 |
| WO | WO 16/038617 | 3/2016 |
| WO | WO 16/050890 | 4/2016 |
| WO | WO 16/060276 | 4/2016 |
| WO | WO 16/073251 | 5/2016 |
| WO | WO 16/130609 | 8/2016 |
| WO | WO 17/044659 | 3/2017 |
| WO | WO 17/075257 | 5/2017 |
| WO | WO 17/172766 | 10/2017 |
| WO | WO 17/176873 | 10/2017 |
| WO | WO 18/016483 | 1/2018 |
| WO | WO 18/200663 | 11/2018 |
| WO | WO 18/204483 | 11/2018 |
| WO | WO 18/229283 | 12/2018 |
| WO | WO 19/169027 | 9/2019 |
| WO | WO 19/202402 | 10/2019 |
| WO | WO 20/033420 | 2/2020 |
| WO | WO 20/096905 | 5/2020 |
| WO | WO 20/097588 | 5/2020 |
| WO | WO 20/112957 | 6/2020 |
| WO | WO 20/201446 | 10/2020 |
| WO | WO 20/205978 | 10/2020 |
| WO | WO 21/216504 | 10/2021 |

OTHER PUBLICATIONS

Andrade-Eiroa et al., Jun. 2016, Solid-phase extraction of organic compounds: A critical review (Part I), TrAC Trends in Analytical Chemistry, 80:641-654.

Cardenas et al., 2016, Engineering cofactor and transport mechanisms in *Saccharomyces cerevisiae* for enhanced acetyl-CoA and polyketide biosynthesis. Metab Eng, 36:80-89.

Chabrol, 2012, The hideous price of beauty An investigation into the market of deep-sea shark liver oil. Edited by: The Bloom Association.

Chang et al., 2007, Engineering *Escherichia coli* for production of functionalized terpenoids using plant P450s. Nat Chem Biol, 3:274-277.

Chaturvedula et al., 2011, Cucurbitane glycosides form Siraitia grosvenorii, J. Carbohydr. Chem., 30(1):16-26.

Chaturvedula et al., 2011, Enzymatic and acid hydrolysis of steviol and cucurbitane glycosides, Int. J. Pharm. Biomed. Res., 2(2):135-139.

Chaturvedula et al., Jan. 2011, Comparative phytochemical studies of the commercial extracts of Siraitia grosvenorii, Journal of Pharmacy Research, 4(9):3166-3167.

Chen et al., 2018, Kumada arylation of secondary amides enabled by chromium catalysis for unsymmetric ketone synthesis under mild conditions, ACS Catalysis, 8:5864-5868.

Chen et al., Jan. 2005, Cucurbitacins and cucurbitane glycosies: structures and biologial activities, Natural Product Reports, 22(3), 14 pp.

Chiu et al., 2013, Biotransformation of mogrosides from siraitia grosvenorii swingle by *Saccharomyces cerevisiae*, J. Agric. Food Chem., 61:7127-7134.

Dai et al., 2015, Functional characterization of cucurbtadienol synthase and triterpene glycosyltransferase involved in biosynthesis of mogrosides from siraitia grosvenorii, Plant Cell Physiol., 56(6):1172-1182.

de Felipe et al., 2004, Targeting of Proteins Derived from Self-Processing Polyproteins Containing Multiple Signal Sequences, Traffic, 5:616-626.

de Felipe, 2004, Skipping the co-expression problem: the new 2A "Chysel" technology, Genetic Vaccines and Ther. 2:13.

Devos et al., 2000, Practical limits of function prediction, Proteins: Structure, Function, and Genetics, 41:98-107.

Donald et al., Sep. 1997, Effects of Overproduction of the Catalytic Domain of 3-Hydroxy-3-Methylglutaryl Coenzyme A Reductase on Squalene Synthesis in *Saccharomyces cerevisiae*, Appl Environ Microbiol., 63(9):3341-3344.

GenBank: AEM42982.1, cucurbitadienol synthase [Siraitia grosvenorii], Dec. 1, 2012, 2 pp.

Ghimire et al., 2009, Improved squalene production via modulation of the methylerythritol 4-phosphate pathway and heterologous expression of genes from Streptomyces peucetius ATCC 27952 in *Escherichia coli*. Appl Environ Microbiol, 75:7291-7293.

Ghimire et al., 2016, Advances in Biochemistry and Microbial Production of Squalene and Its Derivatives. J Microbiol Biotechnol, 26:441-451.

Gruchattka et al., Dec. 23, 2015, In Vivo Validation of In Silico Predicted Metabolic Engineering Strategies in Yeast: Disruption of α-Ketoglutarate Dehydrogenase and Expression of ATP-Citrate Lyase for Terpenoid Production. Plos One, 10(12):e0144981.

Itkin et al., 2016 The biosynthetic pathway of the nonsugar, high-intensity sweetener mogroside V from siraitia grosvenorii, PNAS, 113(47):E7619-E7628 and supplemental material.

(56) References Cited

OTHER PUBLICATIONS

Jia et al., 2009, A minor, sweet cucurbitane glycoside from siraitia grosvenorii, Natural Product Communications, 4(6):769-772.
Joska et al., May 2014 A universal cloning method based on yeast homologous recombination that is simple, efficient, and versatile, J. Microbiol. Methods, 100: 46-51.
Kasai et al., 1988, Glycosides from Chinese medicinal plant, hemsleya panacis-scandens, and structure-taste relationship of cucurbitane glycosides, Chemical and Pharmaceutical Bulletin, 36(1):234-243.
Katabami et al., 2015, Production of squalene by squalene synthases and their truncated mutants in *Escherichia coli*. J Biosci Bioeng, 119:165-171.
Kinghorn et al., 1998, Noncariogenic intense natural sweeteners, Med. Res. Rev. 18(5):347-360.
Kirby et al. Engineering triterpene production in *Saccharomyces cerevisiae*-β-amyrin synthase from Artemisia annua, Febs J. Apr. 2008; 275(8):1852-9.
Kisselev, Jan. 2002, Polypeptide release factors in prokaryotes and eukaryotes: same function, different structure, Structure, 10:8-9.
Kozak et al., 2014, Engineering acetyl coenzyme A supply: functional expression of a bacterial pyruvate dehydrogenase complex in the cytosol of *Saccharomyces cerevisiae*. MBio, 5:e01696-01614.
Lemaigre and Rousseau, Transcriptional control of genes that regulate glycolysis and gluconeogenesis in adult liver, Biochem. J. 303:1-14 (1994).
LeVan et al., 2008, Section 16: Adsorbents and Ion Exchange, In Perry's Chemical Engineers' Handbook, 8th edition. Green ed., McGraw-Hill, New York, pp. 16-1-16-10.
Lewin, Genes V (Oxford University Press, Oxford), pp. 847-873.
Li et al., 2006, Cucurbitane glycosides from unripe fruits of Lo Han Kuo (*Siraitia grosvenori*), Chem. Pharm. Bull, 54(10):1425-1428.
Li et al., 2007, Cucurbitane glycosides from unripe fruits of siraitia grosvenori, Chem. Pharm. Bull. 55(7):1082-1086.
Li et al., 2014, Chemistry and pharmacology of siraitia grosvenorii: a review, Chinese Journal of Natural Medicines, 12(2):89-102.
Li et al., 2017, Cucurbitane glycosides from the fruit of siraitia grosvenori and their effects on glucose uptake in human HepG2 cells in vitro, Food Chemistry, 228:567-573.
Loeken et al., 1993, Effects of mutation of the CREB binding site of the somatostatin promoter on cyclic AMP responsiveness in CV-1 cells, Gene Expr. 3:253-264.
Luo et al., 2016, Liquid chromatography with tandem mass spectrometry method for the simultaneous determination of multiple sweet mogrosides in the fruits of siraitia grosvenorii and its marketed sweeteners, J. Sep. Sci, 39:4124-4135.
Matsumoto et al., 1990, Minor cucurbitane-glycosides from fruits of siraitia grosvenori (cucurbitaceae), Chem. Pharm. Bull., 38(7):2030-2032.
McGehee et al., 1993, Differentiation-specific element: a cis-acting developmental switch required for the sustained transcriptional expression of the angiotensinogen gene during hormonal-induced differentiation of 3T3-L1 fibroblasts to adipocyteshee et al., Mol. Endocrinol. 7:551-560.
Mehrotra et al., 2014, Steviol glycosides and their use in food processing: a review, Innovare Journal of Food Science, 2(1):7-13.
Narendranath et al., May 2005, Relationship between pH and Medium Dissolved Solids in Terms of Growth and Metabolism of Lactobacilli and *Saccharomyces cerevisiae* during Ethanol Production, Appl Environ Microbiol., 71(5): 2239-2243.
Newman et al., 2006, High-level production of amorpha-4,11-diene in a two-phase partitioning bioreactor of metabolically engineered *Escherichia coli*. Biotechnol Bioeng, 95:684-691.
Noguchi et al., May 2008, Sequential glucosylation of a furofuran lignan, (+)-sesaminol, by Sesamum indicum UGT71A9 and UGT94D1 glucosyltransferases, Plant J., 54(3):415-427.
O'Reilly et al., 1992, Identification of an Activating Transcription Factor( ATF) Binding Site in the Human Transforming Growth Factor-/32 Promoter, J. Biol. Chem. 267:19938-19943.

Pandey et al., 2014, Enzymatic Biosynthesis of Novel Resveratrol Glucoside and Glycoside Derivatives, Applied and Environmental Microbiology, 80(23):7235-7243.
Peng et al., 2015, Controlling heterologous gene expression in yeast cell factories on different carbon substrates and across the diauxic shift: a comparison of yeast promoter activities, Microb Cell Fact, 14:91.
Perez Gutierrez, 2007, Triperpenes, in Handbook of Compounds with Cytotoxic Activity Isolated from Pants, Nova Science Publishers Inc., p. 511.
Płotka-Wasylka J et al., New Polymeric Materials for Solid Phase Extraction, Crit Rev Anal Chem., published online on Apr. 11, 2017, pp. 373-383.
Prakash et al., 2014, Additional new minor cucurbitane clycosieds from Siraitia grosvenorii, Molecules, 19:3669-3680.
Prakash et al., Jul. 2008, development of rebiana, a natural, non-caloric sweetener, Food and Chemical Toxicology, 9 pp.
Qing et al., 2017, Systematic identification of flavonols, flavonol glycosides, triterpene and siraitic acid glycosides from siraitia grosvenorii using high-performance liquid chromatography/quadrupole-time-of-flight mass spectrometry combined with a screening strategy, Journal of Pharmaceutical and Biomedical Analysis, 138:240-248.
Rodriguez et al., 2016, ATP citrate lyase mediated cytosolic acetyl-CoA biosynthesis increases mevalonate production in *Saccharomyces cerevisiae*, Microb Cell Fact, 15:48.
Sajid et al., May 2017, Porous membrane protected micro-solid-phase extraction: A review of features, advancements and applications, Anal Chim Acta., 965:36-53.
Salmon et al., Jul. 2016, A conserved amino acid residue critical for product and substrate specificity in plant triterpene synthases, Proc Natl Acad Sci U S A. 26; 113(30): E4407-E4414.
Sawai et al. Triterpenoid Biosynthesis and Engineering in Plants, Front Plant Sci. Jun. 30, 2011; 2:25.
Shen et al., 2014, Rapid identification and quantification of five major mogrosides in *Siraitia grosvenorii* (Luo-Han-Guo) by high performance liquid chromatography-triple quadrupole linear trap tandem mass spectrometry combined with microwave-assisted extraction, Microchemical Journal, 116:142-150.
Shiba et al., 2007, Engineering of the pyruvate dehydrogenase bypass in *Saccharomyces cerevisiae* for high-level production of isoprenoids. Metab Eng, 9:160-168.
Shibuya et al., 2004, Cucurbitadienol synthase, the first committed enzyme for cucurbitacin biosyntheis, is a distinct enzyme from cycloartenol synthase for phytosterol biosynthesis, Tetrahedron 60:6995-7003.
Su et al. Jul. 2017, Molecular and biochemical characterization of squalene synthase from Siraitia grosvenorii, Biotechnol Lett. vol. 39, Issue 7, pp. 1009-1018.
Szarek et al., 1984, L-glucose. A convenient synthesis from D-glucose, Can. J. Chem., 62(4):671-674.
Tai et al., 2013, Engineering the push and pull of lipid biosynthesis in oleaginous yeast *Yarrowia lipolytica* for biofuel production. Metab Eng, 15:1-9.
Takase et al. 2015, Control of the 1,2-rearrangement process by oxidosqualene cyclases during triterpene biosynthesis, Org Biomol Chem. 13(26):7331-6.
Takemoto et al., 1983, Studies on the constituents of fructus momordicae. III. Structure of mogrosides, Pharmaceutical Journal, 103(11):1167-1173.
Tang et al., 2011, An efficient approach to finding siraitia grosvenorii triterpene biosynthetic genes by RNA-seq and digital gene expression analysis, BMC Genomics, 12:343.
Thompson et al., 2014, Squalene production using *Saccharomyces cerevisiae*, i-ACES, 1(1), 7 pp.
Treisman et al., 1990, The SRE: a growth factor responsive transcriptional regulator, Seminars in Cancer Biol. 1:47-58.
U.S. FDA list of Everything Added to Food in the U.S. (EAFUS), available at http://www.accessdata.fda.gov/scripts/fcn/fcnNavigation.cfm?rpt=eafusListing, last accessed Nov. 16, 2015, 186 pp.
Wang et al., 2015, Hyperproduction of β-Glucanase Exg1 promotes the bioconversion of mogrosides in *Saccharomyces cerevisiae* mutants

(56) References Cited

OTHER PUBLICATIONS defective in mannoprotien deposition, Journal of Agricultural and Food Chemistry, 63:10271-10279.
Wang et al., 2019, *Dekkera bruxellesis*, a beer yeast that specifically bioconverts mogroside extracts into the intense natural sweetener siamensode I, Food Chemistry, 276:43-49.
Wang et al., Aug. 20, 2014, Cucurbitane glycosides derived from mogroside IIE: structure-taste relationships, antioxidant activity, and acute toxicity, Molecules, 19(8):12676-12689.
Westfall et al., 2012, Production of amorphadiene in yeast, and its conversion to dihydroartemisinic acid, precursor to the antimalarial agent artemisinin. Proc Natl Acad Sci U S A, 109:E111-118.
Whisstock et al., 2003, Prediction of protein function from protein sequence and structure, Quarterly Review of Biophysics, 36(3):307-340.
Wiet et al., 1993, Fat concentration affects sweetness and sensory profiles of sucrose, sucralose, and aspartame, J. Food Sci., 58(3):599-602.
Witkowski et al., 1999, Conversion of a β-ketoacyl synthase to a malonyl decarboxylase by replacement of the active-site cysteine with glutamine, Biochemistry, 38:11643-11650.
Xu et al., 2015, Exploring in vitro, in vivo metabolism of mogroside V and distribution of its metabolites in rats by HPLC-ESI-IT-TOF-MS$^n$, Journal of Pharmaceutical and Biomedical Analysis, 115:418-430.
Yang et al., 2016, Metabolites of siamenoside I and their distributions in rats, Molecules, 21:1-20.
Yang et al., Sep. 2005, Grosmomoside I, a new cucurbitane triterpenoid glycoside from fruits of *Momordica grosvenori*, Chinese Traditional and Herbal Drugs, 36(9):1285-1290.
Ye et al., 1994, Characterization of a Silencer Regulatory Element in the Human Interferon-y Promoter, J. Biol. Chem. 269:25728-25734.
Zhang et al., 2012, Identification of flavonol and triperpene glycosides in Lui-Han-Guo extract using ultra-high performance liquid chromatography/quadrupole time-of-flight mass spectrometry, Journal of Food Compsition and Analysis, 25:142-148.
Zhang et al., 2015, Functional pyruvate formate lyase pathway expressed with two different electron donors in *Saccharomyces cerevisiae* at aerobic growth. FEMS Yeast Res, 15:fov024.
Zhang et al., 2016, Oxidation of Cucurbitadienol Catalyzed by CYP87D18 in the Biosynthesis of Mogrosides from Siraitia grosvenorii. Plant Cell Physiol 57:1000-1007.
Zhou et al., 2012, Enhanced alpha-ketoglutarate production in Yarrowia lipolytica WSH-Z06 by alteration of the acetyl-CoA metabolism. J Biotechnol, 161:257-264.
Zhou et al., 2016, Comprehensive analysis of 61 characteristic constituents from siraitiae fructus using ultrahigh-pressure liquid chromatography with time-of-flight mass spectrometry, Journal of Pharmaceutical and Biomedical Analysis, 125:1-14.
Zhou et al., 2017, Biotransformation of total saponins in siraitia fructus by human intestinal microbiota of normal and type 2 diabetic patients: comprehensive metabolite identification and metabolic profile elucidation using LC-Q-TOF/MS, Journal of Agricultural and Food Chemistry, 65:1518-1524.
International Search Report dated Mar. 30, 2020 in PCT/US19/059498.
Database GNPD [Online] Mintel; Aug. 1, 2019 (Aug. 1, 2019), anonymous: "Siraitia Grosvenorii Drink", Database accession No. 6765873 Ingredients.
Database GNPD [Online] Mintel; Apr. 11, 2019 (Apr. 11, 2019), anonymous: "Vanilla Flavor Whey Protein Dietary Supplement", Database accession No. 6469573 Ingredients.
Database GNPD [Online] Mintel; Nov. 11, 2020 (Nov. 11, 2020), anonymous: "Lemon-Lime BCAA + Creatine Perform Powder", Database accession No. 8258975 Ingredients.
Database GNPD [Online] Mintel; Jun. 14, 2019 (Jun. 14, 2019), anonymous: "Herbal Water", Database accession No. 6637495 Ingredients.
Database GNPD [Online] Mintel; Jul. 19, 2012 (Jul. 19. 2012), anonymous: "Natural Appetite Management Supplement Drink", Database accession No. 1838679 Ingredients.
Database GNPD [Online] Mintel; Sep. 28, 2020 (Sep. 28, 2020), anonymous: "Lemon Tea Drink with Stevia and Monk Fruit", Database accession No. 8138517 Ingredients.
Database GNPD [Online] Mintel; Mar. 9, 2020 (Mar. 9, 2020), anonymous: "Honeysuckle, Momordica Grosvenori and Snow Pear Black Tea", Database accession No. 7425799 Ingredients.
Database GNPD [Online] Mintel; Nov. 9, 2017 (Nov. 9, 2017), anonymous: "Vanilla Cold Brew Coffee", XP055915994, Database accession No. 5227311 Ingredients.
Deng et al., 2018, Efficient expression of cyclodextrin glycosyltransferase from Geobacillus stearothermophilus in *Escherichia coli* by promoter engineering and downstream box evolution, Journal of Biotechnology, 266:77-83.
Ji et al., May 15, 2013, Recent progress in biochemical properties and functions of UDP-glycosyltransferase during plant secondary metabolism, Food Science, 34(9):316-323.
Lee et al., 2017, Optimization of leucrose production by dextransucrase from *Streptococcus* mutans and its application as an adipogenesis regulator, Journal of Functional Foods, 39:238-244.
Monchois et al., 1996, Cloning and sequencing of a gene coding for a novel dextransucrase from Leuconostoc mesenteroides NRRL B-1299 synthesizing only α(1-6) and α(1-3) linkages, Gene, 182:23-32.
Wang et al., Sep. 2019, Analysis of mogrosides in siraitia grosvenorii fruits at different stages of maturity, Natural Product Communications, 14(1).
Broun et al., 1998, Catalytic plasticity of fatty acid modification enzymes underlying chemical diversity of plant lipids, Science, 282:1315-1317.
Dols et al., Apr. 1998, Characterization of the different dextransucrase activities excreted in glucose, fructose, or sucrose medium by Leuconostoc mesenteroides NRRL B-1299, Applied and Environmental Microbiology, 64(4):1298-1302.
Gotoh, Jan. 5, 1992, Substrate recognition sites in cytochrome P450 family 2 (CYPB) proteins inferred from comparative analyses of amino acid and coding nucleotide sequence, The Journal of Biological Chemistry, 267(1):83-90.
Seffernick et al., 2001, Melamine deaminase and atrazine chlorohydrolase: 98 percent identical but functionally difference, Journal of Bacteriology, 183(8):2405-2410.
Uitdehaag et al., 2002, Catalytic mechanism and product specificity of cyclodextrin glycosytransferase, a prototypical transglycosylase from the α-amylase family, Enzyme and Microbial Technology, 30:195-304.
Wang et al., Jan. 5, 2018, Biotransformation of mogrosides, Sweeteners, pp. 153-165.
Xu et al., 2021, Selective enzymatic α-1,6-monoglucosylation of mogroside IIIE for the bio-creation of α-siamenoside I, a potential high-intensity sweetener, Food Chemistry, 359:1-9.
Brenda, Sequence of CDGT1-NIACI, Ec No. 2.4.1.19, Jan. 2023.
Wang et al., 2019, *Dekkera bruxellensis*, a beer yeast that specifically bioconverts mogroside extracts into the intense natural sweetener siamensode I, Food Chemistry, supplementary data.
Zhou et al., Aug. 16, 2010, Enzymatic synthesis of α-glucosyl-timosaponin BII catalyzed by the extremely thermophilic enzyme: Toruzyme 3.0L, Carbohydrate Research, 345(12)1752-1759.
Ahmad et al., Jun. 2000, Spectroscopic Data of Saponins, CRC-Press, pp. 963-965.
CAS Registry No. 1126032-65-2, Entered STN: Mar. 24, 2009.
CAS Registry No. 126105-11-1, Entered STN: Mar. 30, 1990.
CAS Registry No. 126105-12-2, Entered STN: Mar. 30, 1990.
CAS Registry No. 130567-83-8, Entered STN: Nov. 23, 1990.
CAS Registry No. 1421942-59-7, Entered STN: Feb. 27, 2013.
CAS Registry No. 1613527-65-3, Entered STN: Jul. 8, 2014.
CAS Registry No. 1707161-17-8, Entered STN: May 18, 2015.
CAS Registry No. 189307-15-1, Entered STN: May 30, 1997.
CAS Registry No. 2096516-68-4, Entered STN: May 22, 2017.
CAS Registry No. 88901-37-5, Entered STN: Nov. 16, 1984.
CAS Registry No. 88901-41-1, Entered STN: Nov. 16, 1984.
CAS Registry No. 88901-42-2, Entered STN: Nov. 16, 1984.

(56) References Cited

OTHER PUBLICATIONS

CAS Registry No. 88901-43-3, Entered STN: Nov. 16, 1984.
CAS Registry No. 88901-46-6, Entered STN: Nov. 16, 1984.
CAS Registry No. 88915-64-4, Entered STN: Nov. 16, 1984.
Chatzifragkou et al., 2021, Chapter 18: Analysis of carbohydrates and glycoconjugates in food by CE and HPLC, in Carbohydrate Analysis by Modern Liquid Phase Separation Techniques, El Rassi ed., Elsevier, pp. 815-842.
Gunjal et al., 2020, Chapter 5: Pectinase in degradation of lignocellulosic wastes, in Enzymes in Degradation of the Lignocellulosic Wastes, Springer, pp. 71-103.
Izawa et al., 2010, 4.16. Human-environment interaction—taste, in Comprehensive Natural Products II, Mander et al., eds., Elsevier, pp. 631-671.
Lim, 2012, Siraitia grosvenorii, in Edible Medicinal and Non-Medicinal Plants., vol. 2, Fruits, Springer, pp. 392-400.
McMurry, 2015, 25-3 D,L Sugars, in Organic Chemistry, Cengage Learning, p. 839.
Merino et al., 2007, Progress and challenges in enzyme development for biomass utilization, Adv Biochem Engin/Biotechnol, 108:105-120.
Plou et al., 2007, Application of glycosidases and transglycosidases in the synthesis of oligosaccharides, in Industrial Enzymes: Structure, Function and applications, Polaina et al., eds., Springer, pp. 141-157.
Schomburg et al., eds., 2006, Springer Handbook of Enzymes, vol. 31, Sucrose synthase, 2.4.1.13, pp. 113-125.
Schomburg et al., eds., 2006, Springer Handbook of Enzymes, vol. 31, Class 2, Transferases IV, Dextransucrase, 2.4.1.5, pp. 49-59.
Shoda, Jul. 2001, Chapter 5.3.1: Enzymatic glycosylation, in Glycoscience; Chemistry and Chemical Biology I-III, Frasier-Reid et al., eds., Springer, pp. 1466-1496.
Stoddart,1984, Chapter 5. Polysaccharide assembly in eukaryotes, in The Biosynthesis of Polysaccharides, Croom Helm, London & Sydney, pp. 179-261.
Veana et al., 2018, Chapter 10. Invertase: an enzyme with importance in confectionery food industry, in Enzymes in Food Technology, Kuddus ed., Springer, pp. 187-212.
Wagner et al., eds., 2015, Fructus Siraitiae/Momordicase-Luohanguo, in Chromatographic Fingerprint Analysis of Herbal Medicines., vol. 3, Springer International Publishing Switzerland, pp. 197-198.

* cited by examiner

C Melo

METHODS FOR MAKING HIGH INTENSITY SWEETENERS

CROSS-REFERENCE TO RELATED APPLICATIONS

This application is a U.S. National Phase of International Application No. PCT/US2019/059498, filed on Nov. 1, 2019 and published on May 14, 2020 as WO 2020/096907, which claims the benefit of U.S. Provisional Application No. 62/757,141 filed on Nov. 7, 2018, the contents of which are hereby incorporated by reference in their entireties for all purposes.

REFERENCE TO SEQUENCE LISTING, TABLE, OR COMPUTER PROGRAM LISTING

The present application is being filed along with a Sequence Listing in electronic format. The Sequence Listing is provided as a file entitled SNMX051NP-Substitute 3.TXT, created Jul. 9, 2024, which is 4,074 kb in size. The information in the electronic format of the Sequence Listing is incorporated herein by reference in its entirety.

BACKGROUND

Field

The present disclosure relates to methods, systems and compositions for producing sweet tasting compounds, as well as compositions comprising the sweet tasting compounds.

Background Description

The taste system provides sensory information about the chemical composition of the external world. Taste transduction is one of the most sophisticated forms of chemical-triggered sensation in animals. Signaling of taste is found throughout the animal kingdom, from simple metazoans to the most complex of vertebrates. Mammals are believed to have five basic taste modalities: sweet, bitter, sour, salty, and umami (the taste of monosodium glutamate, a.k.a. savory taste).

For centuries, various natural and unnatural compositions and/or compounds have been added to ingestible compositions, including foods and beverages, and/or orally administered medicinal compositions to improve their taste. Although it has long been known that there are only a few basic types of "tastes," the biological and biochemical basis of taste perception was poorly understood, and most taste improving or taste modifying agents have been discovered largely by simple trial and error processes.

With respect to the sweet taste, diabetes, and cardiovascular disease are health concerns on the rise globally, but are growing at alarming rates in the United States. Sugar and calories are key components that can be limited to render a positive nutritional effect on health. High-intensity sweeteners can provide the sweetness of sugar, with various taste qualities. Because they are many times sweeter than sugar, much less of the sweetener is required to replace the sugar.

High-intensity sweeteners have a wide range of chemically distinct structures and hence possess varying properties, such as, without limitation, odor, flavor, mouthfeel, and aftertaste. These properties, particularly flavor and aftertaste, are well known to vary over the time of tasting, such that each temporal profile is sweetener-specific.

There has been significant recent progress in identifying useful natural flavoring agents, such as for example sweeteners such as sucrose, fructose, glucose, erythritol, isomalt, lactitol, mannitol, sorbitol, xylitol, certain known natural terpenoids, flavonoids, or protein sweeteners. See, e.g, Kinghom, et al., "Noncariogenic Intense Natural Sweeteners," Med. Res. Rev. 18 (5) 347-360 (1998) (discussing discovered natural materials that are much more intensely sweet than common natural sweeteners such as sucrose, fructose, and the like.) Similarly, there has been recent progress in identifying and commercializing new artificial sweeteners, such as aspartame, saccharin, acesulfame-K, cyclamate, sucralose, and the like. See, e.g., Ager, et al., Angew. Chem. Int. Ed. 37, 1802-1817 (1998). The entire contents of the references identified above are hereby incorporated herein by reference in their entirety.

Sweeteners such as saccharin and 6-methyl-1,2,3-oxathi-azin-4(3H)-one-2,2-dioxide potassium salt (acesulfame potassium) are commonly characterized as having bitter and/or metallic aftertastes. Products prepared with 2,4-dihydroxybenzoic acid are claimed to display reduced undesirable aftertastes associated with sweeteners, and do so at concentrations below those concentrations at which their own tastes are perceptible. Also, high intensity sweeteners such as sucralose and aspartame are reported to have sweetness delivery problems, i.e., delayed onset and lingering of sweetness. See S. G. Wiet, et al., J. Food Sci., 58(3):599-602, 666 (1993).

There is a need for new sweetening compounds, sweet taste enhancers, and compositions containing such compounds and enhancers, having improved taste and delivery characteristics. In addition, there is a need for foods containing new sweetening compounds and/or sweet taste enhancers with such desirable characteristics.

SUMMARY

Disclosed herein include a method of producing Compound 1 having the structure of:

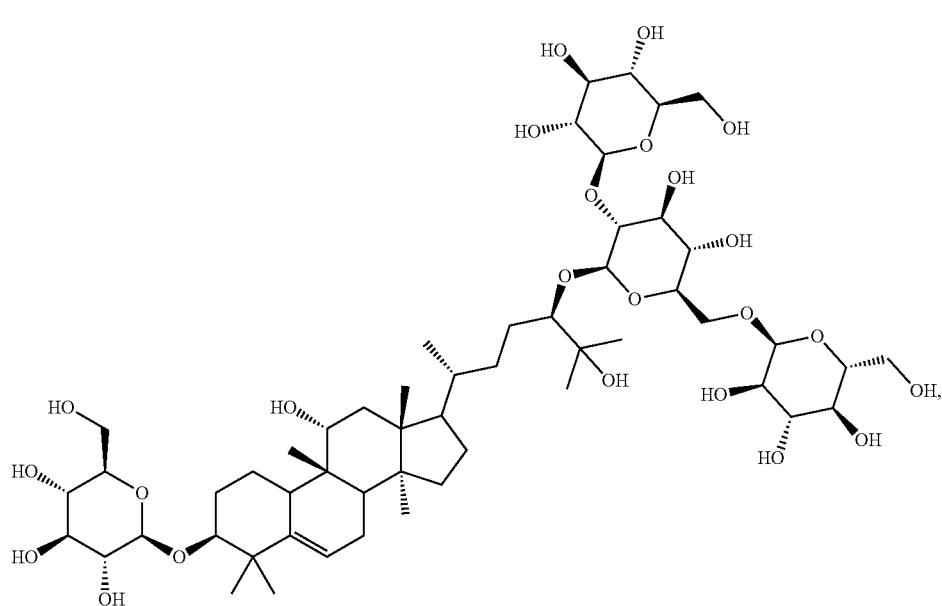

(1)

the method comprising: contacting mogroside III$_E$ with a recombinant host cell that comprises a first enzyme capable of catalyzing a production of Compound 1 from mogroside III$_E$, wherein the recombinant host cell comprises: (1) a cytochrome P450 that comprises an amino acid sequence having at least 80% sequence identity to the sequence of any one of SEQ ID NOS: 1025, 1027, 1029, 1031, 1033, 1035, 1037, 1039, 1041, 1043, 1045, 1047, and 1049; and/or (2) a cytochrome P450 that is encoded by a nucleic acid sequence having at least 80% sequence identity to any one of SEQ ID NOs: 1024, 1026, 1028, 1030, 1032, 1034, 1036, 1038, 1040, 1042, 1044, 1046, and 1048; and/or (3) a glycosylating enzyme that comprises an amino acid sequence having at least 80% sequence identity to the sequence of any one of SEQ ID NOs: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or (4) a glycosylating enzyme that is encoded a nucleic acid sequence having at least 80% sequence identity to the sequence of any one of SEQ ID NOs: 1050, 1052, 1054, 1056, 1058, 1060, 1062, 1064, 1066, 1068, 1070, 1075, 1077, 1079, 1081, 1083, 1085, 1087, 1089, 1091, and 1093; and/or (5) an epoxide hydrolase that comprises an amino acid sequence having at least 80% sequence identity to the sequence of SEQ ID NO: 1073; and/or (6) an epoxide hydrolase that is encoded by a nucleic acid sequence having at least 80% sequence identify to the sequence of SEQ ID NO: 1072.

In some embodiments, the recombinant host cell comprises (1) a cytochrome P450 that comprises an amino acid sequence having at least 95% sequence identity to the sequence of any one of SEQ ID NOs: 1025, 1027, 1029, 1031, 1033, 1035, 1037, 1039, 1041, 1043, 1045, 1047, and 1049; and/or (2) a cytochrome P450 that is encoded by a nucleic acid sequence having at least 95% sequence identity to any one of SEQ ID NOs: 1024, 1026, 1028, 1030, 1032, 1034, 1036, 1038, 1040, 1042, 1044, 1046, and 1048; and/or (3) a glycosylating enzyme that comprises an amino acid sequence having at least 95% sequence identity to the sequence of any one of SEQ ID NOs: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or (4) a glycosylating enzyme that is encoded a nucleic acid sequence having at least 95% sequence identity to the sequence of any one of SEQ ID NOs: 1050, 1052, 1054, 1056, 1058, 1060, 1062, 1064, 1066, 1068, 1070, 1075, 1077, 1079, 1081, 1083, 1085, 1087, 1089, 1091, and 1093; and/or (4) an epoxide hydrolase that comprises an amino acid sequence having at least 95% sequence identity to the sequence of SEQ ID NO: 1073; and/or (6) an epoxide hydrolase that is encoded by a nucleic acid sequence having at least 95% sequence identify to the sequence of SEQ ID NO: 1072. In some embodiments, the recombinant host cell comprises (1) a cytochrome P450 that comprises an amino acid sequence having at least 95% sequence identity to the sequence of any one of SEQ ID NOs: 1025, 1027, 1029, 1031, 1033, 1035, 1037, 1039, 1041, 1043, 1045, 1047, and 1049; and/or (2) a cytochrome P450 that is encoded by a nucleic acid sequence having at least 95% sequence identity to any one of SEQ ID NOs: 1024, 1026, 1028, 1030, 1032, 1034, 1036, 1038, 1040, 1042, 1044, 1046, and 1048; and/or (3) a glycosylating enzyme that comprises an amino acid sequence having at least 95% sequence identity to the sequence of any one of SEQ ID NOs: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or (4) a glycosylating enzyme that is encoded a nucleic acid sequence having at least 95% sequence identity to the sequence of any one of SEQ ID NOs: 1050, 1052, 1054, 1056, 1058, 1060, 1062, 1064, 1066, 1068, 1070, 1075, 1077, 1079, 1081, 1083, 1085, 1087, 1089, 1091, and 1093; and/or (5) an epoxide hydrolase that comprises an amino acid sequence having at least 95% sequence identity to the sequence of SEQ ID NO: 1073; and/or (6) an epoxide hydrolase that is encoded by a nucleic acid sequence having at least 95% sequence identify to the sequence of SEQ ID NO: 1072.

In some embodiments, the recombinant host cell comprises a first gene encoding the first enzyme. For examples, the first gene can be heterologous to the recombinant host cell. In some embodiments, the mogroside III$_E$ is present in and/or produced by the recombinant host cell. In some embodiments, the method comprises cultivating the recombinant host cell in a culture medium under conditions in which the first enzyme is expressed. In some embodiments, the first enzyme is one or more of UDP glycosyltransferases, cyclomaltodextrin glucanotransferases (CGTases), glycotransferases, dextransucrases, cellulases, β-glucosidases, amylases, transglucosidases, pectinases, and dextranases. The CGTase can, for example, comprise an amino acid sequence having at least 70% sequence identity to the sequence of any one of SEQ ID NOs: 1, 3, 78-101, 148, and 154. The dextransucrase can, for example, comprise an amino acid sequence having at least 70% sequence identity to any one of the sequences set forth in SEQ ID NOs: 2, 103, 106-110, 156, 159-162, and 896; or wherein the dextransucrase is encoded by a nucleic acid sequence having at least 70% sequence identity to any one of SEQ ID NOs: 104, 105, 157, 158, and 895. The transglucosidase can, for example, comprise an amino acid sequence having at least 70% sequence identity to the sequence of any one of SEQ ID NOs: 163-291 and 723. The beta-glucosidase can, for example, comprise an amino acid sequence having at least 70% sequence identity to the sequence set forth in any one of SEQ ID NOs: 102, 292, 354-374, and 678-741.

In some embodiments, the method comprises contacting mogroside IIA with the recombinant host cell to produce mogroside III$_E$, wherein the recombinant cell comprises a second enzyme capable of catalyzing a production of mogroside IIIE from mogroside IIA. In some embodiments, the recombinant host cell comprises a second gene encoding the second enzyme. In some embodiments, the mogroside IIA is produced by and/or present in the recombinant host cell. In some embodiments, the second enzyme is one or more of uridine diphosphate-glucosyl transferase (UGT), CGTases, glycotransferases, dextransucrases, cellulases, β-glucosidases, amylases, transglucosidases, pectinases, and dextranases. The UGT can be, for example, UGT73C3 (SEQ ID NO: 4), UGT73C6 (SEQ ID NO: 5), UGT85C2 (SEQ ID NO: 6), UGT73C5 (SEQ ID NO: 7), UGT73E1 (SEQ ID NO: 8), UGT98 (SEQ ID NO: 9 or 407), UGT1576 (SEQ ID NO:15), UGT SK98 (SEQ ID NO:16), UGT430 (SEQ ID NO:17), UGT1697 (SEQ ID NO:18), UGT11789 (SEQ ID NO:19), or comprises an amino acid sequence having at least 70% sequence identity to any one of SEQ ID NOs: 4-9, 15-19, 125, 126, 128, 129, 293-307, 407, 409, 411, 413, 439, 441, 444, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149. The UGT can also, for example, be encoded by a nucleic acid sequence comprising at least 70% sequence identity to any one of the sequences set forth in UGT1495 (SEQ ID NO: 10), UGT1817 (SEQ ID NO: 11), UGT5914 (SEQ ID NO: 12), UGT8468 (SEQ ID NO:13), UGT10391 (SEQ ID NO:14), and SEQ ID NOs: 116-124, 127, 130, 408, 410, 412, 414, 440, 442, 443, 445, 1050, 1052, 1054, 1056, 1058, 1060, 1062, 1064, 1066, 1068, 1070, 1075, 1077, 1079, 1081, 1083, 1085, 1087, 1089, 1091, and 1093.

In some embodiments, the method comprises contacting mogrol with the recombinant host cell, where the recombinant host cell comprises one or more enzymes capable of catalyzing a production of mogroside IIE and/or IIIE from mogrol. In some embodiments, the recombinant host cell comprises one or more genes encoding the one or more enzymes capable of production of mogroside IIE and/or IIIE from mogrol. The mogrol can be, for example, produced by and/or present in the recombinant host cell. In some embodiments, the one or more enzymes capable of catalyzing a production of mogroside IIE and/or IIIE from mogrol comprises one or more of UGTs, CGTases, glycotransferases, dextransucrases, cellulases, β-glucosidases, amylases, transglucosidases, pectinases, and dextranases. The UGT can be, for example, UGT73C3, UGT73C6, 85C2, UGT73C5, UGT73E1, UGT98, UGT1495, UGT1817, UGT5914, UGT8468, UGT10391, UGT1576, UGT SK98, UGT430, UGT1697, or UGT11789, or comprises an amino acid sequence having at least 70% sequence identity to any one of SEQ ID NOs: 4-9, 15-19, 125, 126, 128, 129, 293-307, 405, 406, 407, 409, 411, 413, 439, 441, 444, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149.

In some embodiments, the method comprises contacting a mogroside compound with the recombinant host cell, wherein the recombinant host cell comprises one or more enzymes capable of catalyzing a production of mogroside IIIE from a mogroside compound to produce mogroside IIIE, wherein the mogroside compound is one or more of mogroside IA1, mogroside IE1, mogroside IIA1, mogroside IIE, mogroside IIA, mogroside IIIA1, mogroside IIIA2, mogroside III, mogroside IV, mogroside IVA, mogroside V, and siamenoside. In some embodiments, the recombinant host cell comprises one or more genes encoding the one or more enzymes capable of catalyzing the production of Mogroside IIIE from the mogroside compound. In some embodiments, the mogroside compound is produced by and/or present in the recombinant host cell. In some embodiments, the one or more enzymes capable of catalyzing the production of mogroside IIIE from the mogroside compound comprises one or more of UGTs, CGTases, glycotransferases, dextransucrases, cellulases, β-glucosidases, amylases, transglucosidases, pectinases, and dextranases. In some embodiments, the mogroside compound is mogroside IIE. In some embodiments, the mogroside compound is morgroside IIA or mogroside IIE, and wherein the contacting with one or more enzymes produces one or more of mogroside IIIA, mogroside IVE and mogroside V. In some embodiments, the method comprises contacting mogroside IA1 with the recombinant host cell, wherein the recombinant host cell comprises a gene encoding UGT98 or UGT SK98 enzyme comprises an amino acid sequence having at least 70% sequence identity to SEQ ID NO: 9, 407, 16, or 306. In some embodiments, the contacting results in production of Mogroside IIA in the cell.

In some embodiments, the method comprises contacting 11-hydroxy-24,25 epoxy cucurbitadienol with the recombinant host cell, wherein the recombinant host cell comprises a third gene encoding an epoxide hydrolase. The 11-hydroxy-24,25 epoxy cucurbitadienol can be present in and/or produced by the recombinant host cell.

In some embodiments, the method comprises contacting 11-hydroxy-cucurbitadienol with the recombinant host cell, wherein the recombinant host cell comprises a fourth gene encoding a cytochrome P450 or an epoxide hydrolase. In some embodiment, the 11-hydroxy-cucurbitadienol is produced by and/or present in the recombinant host cell. In some embodiments, the method comprises contacting 3, 24, 25-trihydroxy cucurbitadienol with the recombinant host cell, wherein the recombinant host cell comprises a fifth gene encoding a cytochrome P450. The 3, 24, 25-trihydroxy cucurbitadienol can be present in and/or produced by the recombinant host cell. In some embodiments, contacting results in production of Mogrol in the recombinant host cell.

In some embodiments, the epoxide hydrolase comprises an amino acid sequence having at least 70% sequence identity to any one of SEQ ID NOs: 21-30, 309-314 and 1073; or the epoxide hydrolase is encoded by a nucleic acid sequence having at least 70% sequence identity to any one of SEQ ID NOs: 114, 115 and 1072.

In some embodiments, the method comprises contacting cucurbitadienol with the recombinant host cell. In some embodiments, the contacting results in production of 11-hydroxy cucurbitadienol. For example, the cucurbitadienol can be produced by and/or present in the recombinant host cell.

In some embodiments, the method comprises contacting one or more of 2, 3-oxidosqualene, dioxidosqualene and diepoxysqualene with the recombinant host cell, wherein the recombinant host cell comprises a seventh gene encoding a polypeptide having cucurbitadienol synthase activity. In some embodiments, the polypeptide having cucurbitadienol synthase activity is a fusion protein comprising a fusion domain fused to a cucurbitadienol synthase. The contacting can, in some embodiments, result in production of cucurbitadienol and/or 24, 25-epoxy cucurbitadienol. In some embodiments, one or more of 2,3-oxidosqualene, dioxidosqualene and diepoxysqualene is produced by and/or present in the recombinant host cell. In some embodiments, the recombinant host cell comprises a gene encoding CYP87D18 or SgCPR protein.

The method, in some embodiments, comprise contacting squalene with the recombinant host cell, wherein the recombinant host cell comprises an eighth gene encoding a squalene epoxidase. The contacting can, for example, result in production of 2,3-oxidosqualene. In some embodiments, the squalene is produced by and/or present in the recombinant host cell.

In some embodiments the method comprises contacting farnesyl pyrophosphate with the recombinant host cell, where the recombinant host cell comprises a ninth gene encoding a squalene synthase. The contacting can, for example, result in production of squalene. In some embodiments, the farnesyl pyrophosphate is produced by and/or present in the recombinant host cell. The squalene synthase can, for example, comprise an amino acid sequence having at least 70% sequence identity to any one of SEQ ID NOs: 69 and 336, or is encoded by a sequence comprising a nucleic acid sequence having at least 70% sequence identity to SEQ ID NO: 337.

In some embodiments, the method comprises contacting geranyl-PP with the recombinant host cell, wherein the recombinant host cell comprises a tenth gene encoding farnesyl-PP synthase. In some embodiments, the contacting results in production of farnesyl-PP. The geranyl-PP can be produced by and/or present in the recombinant host cell. The farnesyl-PP synthase can, for example, comprise an amino acid sequence having at least 70% sequence identity to SEQ ID NO: 338, or is encoded by a nucleic acid sequence having at least 70% sequence identity to SEQ ID NO: 339.

In some embodiments, one or more of the first, second, third, fourth, fifth, sixth, seventh, eighth, ninth, and tenth gene is operably linked to a heterologous promoter. The promoter can be, for example, an inducible, repressible, or constitutive promoter. The recombinant host cell can be, for example, a plant, bivalve, fish, fungus, bacteria, or mammalian cell. In some embodiments, the fungus is selected from the group consisting of *Trichophyton, Sanghuangporus, Taiwanofungus, Moniliophthora, Marssonina, Diplodia, Lentinula, Xanthophyllomyces, Pochonia, Colletotrichum, Diaporthe, Histoplasma, Coccidioides, Histoplasma, Sanghuangporus, Aurcobasidium, Pochonia, Penicillium, Sporothrix, Metarhizium, Aspergillus, Yarrowia*, and *Lipomyces*. For example, the fungus is *Aspergillus nidulans, Yarrowia lipolytica*, or *Rhodosporin toruloides*. In some embodiments, the recombinant host cell is a yeast cell. In some embodiments, the recombinant host cell is a *Saccharomyces cerevisiae* cell or a *Yarrowia lipolytica* cell.

In some embodiments, the method comprises isolating Compound 1. In some embodiments, isolating Compound 1 comprises lysing the recombinant host cell and/or isolating Compound 1 from the culture medium. The method can comprise purifying Compound 1, for example, using HPLC, solid phase extraction, or a combination thereof.

In some embodiments, the method comprises contacting a first mogroside with the recombinant host cell to produce mogroside IIIE before contacting the mogroside IIIE with the first enzyme, where the recombinant host cell comprises a hydrolase. The hydrolase can be, for example, a β-glucan hydrolase. In some embodiments, the hydrolase is EXG1 or EXG2. In some embodiments, the first mogroside a mogroside IV, a mogroside V, a mogroside VI, a siamenoside I, a mogroside $IV_E$, a mogroside $IV_A$, or a combination thereof. In some embodiments, the recombination host cell comprises a gene encoding the hydrolase. In some embodiments, the first mogroside is produced by and/or present in the recombinant host cell.

In some embodiments, the recombinant cell further comprises an oxidosqualene cyclase or a nucleic acid sequence encoding an oxidosqualene cyclase, and where the oxidosqualene cyclase has been modified to produce cucurbitadienol or epoxycucurbitadienol. The oxidosqualene cyclase can be, for example, a cycloartenol synthase or a beta-amyrin synthase. In some embodiments, the recombinant cell comprises cytochrome P450 reductase or a gene encoding cytochrome P450 reductase.

Also disclosed herein include a compound having the structure of Compound 1,

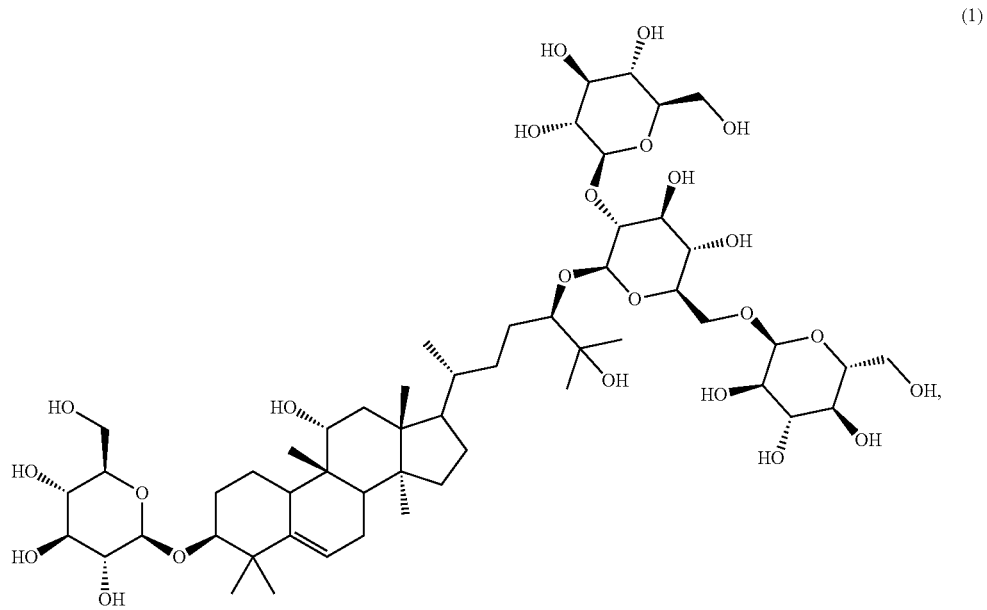 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

where the compound is produced by any of the methods disclosed herein.

Also disclosed herein include a recombinant cell comprising: Compound 1 having the structure:

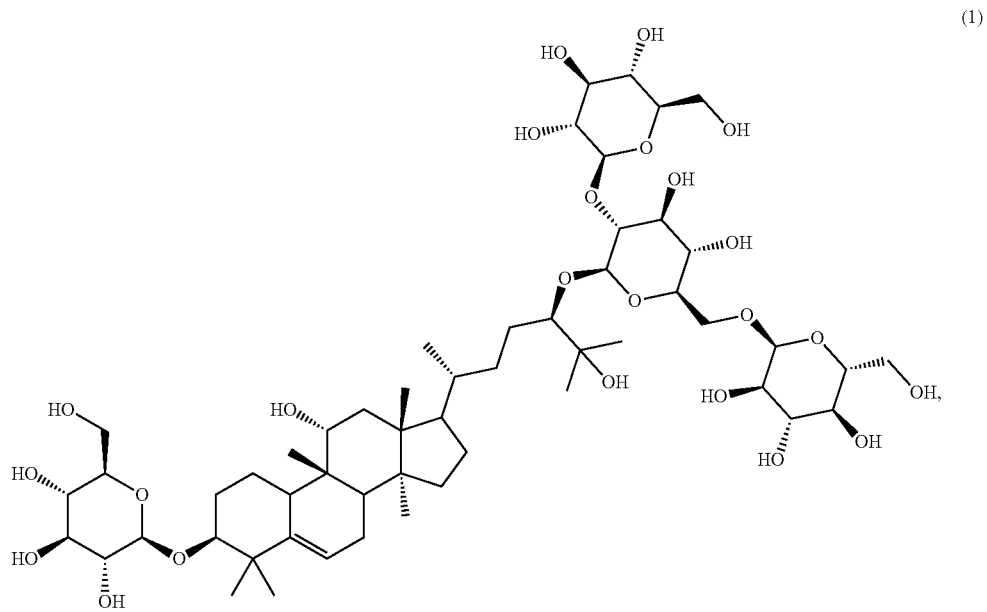 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

a gene encoding an enzyme capable of catalyzing production of Compound 1 from mogroside IIIE, and one or more of (1) a cytochrome P450 that comprises an amino acid sequence having at least 80% sequence identity to the sequence of any one of SEQ ID NOs: 1025, 1027, 1029, 1031, 1033, 1035, 1037, 1039, 1041, 1043, 1045, 1047, and 1049; and/or (2) a cytochrome P450 that is encoded by a nucleic acid sequence having at least 80% sequence identity to any one of SEQ ID NOs: 1024, 1026, 1028, 1030, 1032, 1034, 1036, 1038, 1040, 1042, 1044, 1046, and 1048; and/or (3) a glycosylating enzyme that comprises an amino acid sequence having at least 80% sequence identity to the sequence of any one of SEQ ID NOs: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or (4) a glycosylating enzyme that is encoded a nucleic acid sequence having at least 80% sequence identity to the sequence of any one of SEQ ID NOs: 1050, 1052, 1054, 1056, 1058, 1060, 1062, 1064, 1066, 1068, 1070, 1075, 1077, 1079, 1081, 1083, 1085, 1087, 1089, 1091, and 1093; and/or (5) an epoxide hydrolase that comprises an amino acid sequence having at least 80% sequence identity to the sequence of SEQ ID NO: 1073; and/or (6) an epoxide hydrolase that is encoded by a nucleic acid sequence having at least 80% sequence identify to the sequence of SEQ ID NO: 1072. In some embodiments, the gene is a heterologous gene to the recombinant cell.

Also disclosed include a recombinant cell comprising a first gene encoding a first enzyme capable of catalyzing production of Compound 1 having the structure:

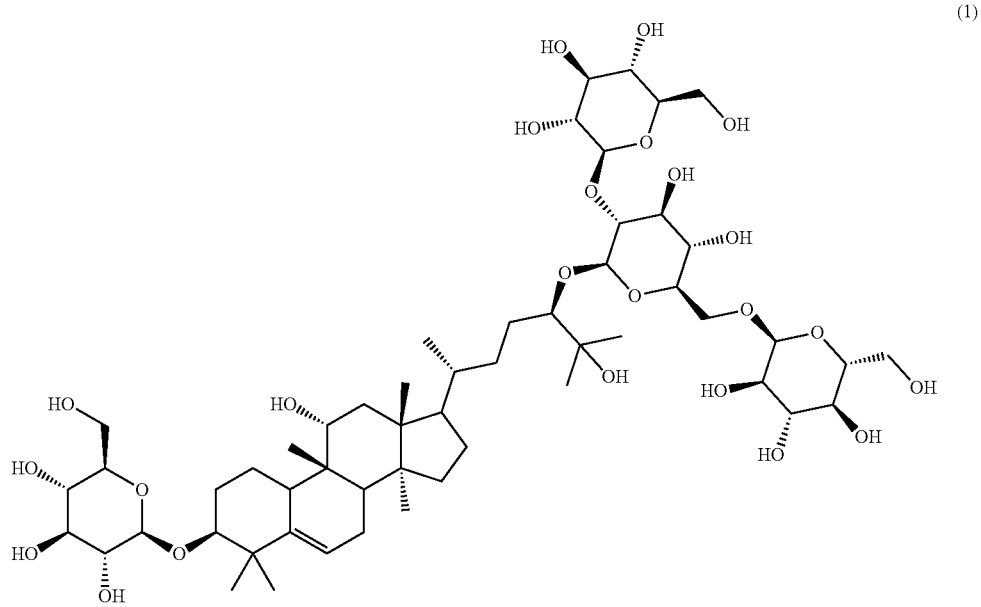 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

from mogroside IIIE, and one or more of (1) a cytochrome P450 that comprises an amino acid sequence having at least 80% sequence identity to the sequence of any one of SEQ ID NOs: 1025, 1027, 1029, 1031, 1033, 1035, 1037, 1039, 1041, 1043, 1045, 1047, and 1049; and/or (2) a cytochrome P450 that is encoded by a nucleic acid sequence having at least 80% sequence identity to any one of SEQ ID NOs: 1024, 1026, 1028, 1030, 1032, 1034, 1036, 1038, 1040, 1042, 1044, 1046, and 1048; and/or (3) a glycosylating enzyme that comprises an amino acid sequence having at least 80% sequence identity to the sequence of any one of SEQ ID NOs: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or (4) a glycosylating enzyme that is encoded a nucleic acid sequence having at least 80% sequence identity to the sequence of any one of SEQ ID NOs: 1050, 1052, 1054, 1056, 1058, 1060, 1062, 1064, 1066, 1068, 1070, 1075, 1077, 1079, 1081, 1083, 1085, 1087, 1089, 1091, and 1093; and/or (5) an epoxide hydrolase that comprises an amino acid sequence having at least 80% sequence identity to the sequence of SEQ ID NO: 1073; and/or (6) an epoxide hydrolase that is encoded by a nucleic acid sequence having at least 80% sequence identify to the sequence of SEQ ID NO: 1072.

In some embodiments, the first enzyme is one or more of UGTs, cyclomaltodextrin glucanotransferases (CGTases), glycotransferases, dextransucrases, cellulases, β-glucosidases, amylases, transglucosidases, pectinases, and dextranases. The CGTase can, for example, comprise an amino acid sequence having at least 70% sequence identity to the sequence of any one of SEQ ID NOs: 1, 3, 78-101, 148, and 154. The dextransucrase can, for example, comprise an amino acid sequence having at least 70% sequence identity to any one of the sequences set forth in SEQ ID NOs: 2, 103, 106-110, 156 and 896; or is encoded by an nucleic acid sequence having at least 70% sequence identity to any one of SEQ ID NOs: 104, 105, 157, 158, and 895. The transglucosidase can, for example, comprise an amino acid sequence having at least 70% sequence identity to the sequence of any one of SEQ ID NOs: 3, 95-102, 163-291, and 723. The beta glucosidase can, for example, comprise an amino acid sequence having at least 70% sequence identity to SEQ ID NOs: 102, 292, 354-376, and 678-741.

In some embodiments, the cell comprises a second gene encoding a uridine diphosphate-glucosyl transferase (UGT). The UGT can, for example, comprise an amino acid sequence having at least 70% sequence identity to any one of the sequences set forth in SEQ ID NO: 4-9, 15-19, 125, 126, 128, 129, 293-307, 407, 409, 411, 413, 439, 441, 444, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; or wherein UGT is encoded by a nucleic acid sequence having at least 70% sequence identity to any one of SEQ ID NOs: 116-124, 127, 130, 408, 410, 412, 414, 440, 442, 443, 445, 1050, 1052, 1054, 1056, 1058, 1060, 1062, 1064, 1066, 1068, 1070, 1075, 1077, 1079, 1081, 1083, 1085, 1087, 1089, 1091, and 1093. In some embodiments, the UGT is encoded by a sequence set forth in UGT1495 (SEQ ID NO: 10), UGT1817 (SEQ ID NO: 11), UGT5914 (SEQ ID NO: 12), UGT8468 (SEQ ID NO: 13), or UGT10391 (SEQ ID NO: 14).

In some embodiments, the cell comprises a third gene encoding UGT98 or UGT SK98 which comprises an amino acid sequence having at least 70% sequence identity to SEQ ID NO: 9, 407, 16, or 306; or wherein the UGT98 is encoded by a nucleic acid sequence set forth in SEQ ID NO: 307. In some embodiments, the cell comprises a fourth gene encoding an epoxide hydrolase. The epoxide hydrolase can, for example, comprise an amino acid sequence having at least 70% sequence identity to any one of SEQ ID NO: 21-30 and 309-314; or is encoded by a nucleic acid sequence having at least 70% sequence identity to any one of SEQ ID NOs: 114 and 115

In some embodiments, the cell comprises a fifth sequence encoding P450. The P450 can, for example, comprise an amino acid sequence having at least 70% sequence identity to any one of SEQ ID NOs: 20, 49, 308, 315, 430, 872, 874, 876, 878, 880, 882, 884, 886, 888, 890, 891, 1025, 1027, 1029, 1031, 1033, 1035, 1037, 1039, 1041, 1043, 1045, 1047, 1049, 1025, 1027, 1029, 1031, 1033, 1035, 1037, 1039, 1041, 1043, 1045, 1047, and 1049; or is encoded by a nucleic acid sequence having at least 70% sequence identity to any one of SEQ ID NOs: 31-48, 316, 318, 431, 871, 873, 875, 877, 879, 881, 883, 885, 887, 889, 892, 1024, 1026, 1028, 1030, 1032, 1034, 1036, 1038, 1040, 1042, 1044, 1046, and 1048.

In some embodiments, the cell comprises a sixth sequence encoding a polypeptide having cucurbitadienol synthase activity. In some embodiments, the polypeptide having cucurbitadienol synthase activity is a fusion protein. For example, the polypeptide having cucurbitadienol synthase activity can comprise an amino acid sequence having at least 70% sequence identity to any one of SEQ ID NOs: 70-73, 75-77, 319, 321, 323, 325, 327-333, 417, 420, 422, 424, 426, 446, 902, 904, 906, 851, 854, 856, 1024, 859, 862, 865, 867, 915, 920, 924, 928, 932, 936, 940, 944, 948, 952, 956, 959, 964, 967, 971, 975, 979, 983, 987, 991, 995, 999, 1003, 1007, and 1011; or is encoded by a nucleic acid sequence having at least 70% sequence identity to any one of SEQ ID NOs: 74, 320, 322, 324, 326, 328, 418, 421, 423, 425, 427, 897, 899, 901, 903, and 905.

In some embodiments, the cell comprises a seventh gene encoding a squalene epoxidase. The squalene epoxidase can, for example, comprise an amino acid sequence having at least 70% sequence identity to any one of SEQ ID NOs: 50-56, 60, 61, 334, and 335; or wherein the squalene epoxidase is encoded by a nucleic acid sequence having at least 70% sequence identity to SEQ ID NO: 335.

In some embodiments, the cell comprises an eighth gene encoding a squalene synthase. The squalene synthase can, for example, comprise an amino acid sequence having at least 70% sequence identity to SEQ ID NO: 69 or 336; or wherein the squalene synthase is encoded by a sequence comprising a nucleic acid sequence set forth in SEQ ID NO: 337. In some embodiments, the cell comprises a ninth gene encoding a farnesyl-PP synthase. The farnesyl-PP synthase can, for example, comprise an amino acid sequence having at least 70% sequence identity to SEQ ID NO: 338, or is encoded by a nucleic acid sequence having at least 70% sequence identity to SEQ ID NO: 339. The cell can be, for example, a mammalian, plant, bacterial, fungal, or insect cell. The fungus can be, for example, *Trichophyton, Sanghuangporus, Taiwanofungus, Moniliophthora, Marssonina, Diplodia, Lentinula, Xanthophyllomyces, Pochonia, Colletotrichum, Diaporthe, Histoplasma, Coccidioides, Histoplasma, Sanghuangporus, Aureobasidium, Pochonia, Penicillium, Sporothrix,* or *Metarhizium*. In some embodiments, the cell is a yeast cell, wherein the yeast is selected from the group consisting of *Candida, Saccharaomyces, Saccharomycotina, Taphrinomycotina, Schizosaccharomyces, Komagataella, Basidiomycota, Agaricomycotina, Tremellomycetes, Pucciniomycotina, Aureobasidium, Coniochaeta,* and *Microboryomycetes*. In some embodiments, the recombinant cell comprises a gene encoding at least one hydrolytic enzyme capable of hydrolyzing mogroside V. In some embodiments. Compound 1 displays tolerance to hydrolytic enzymes in the recombinant cell, wherein the hydrolytic enzymes display capabilities of hydrolyzing Mogroside VI, Mogroside V, Mogroside IV to Mogroside IIIE. In some embodiments, the recombinant cell further comprises an oxidosqualene cyclase or a nucleic acid sequence encoding an oxidosqualene cyclase, and where the oxidosqualene cyclase is modified to produce cucurbitadienol or epoxycucurbitadienol. The oxidosqualene cyclase can, for example, comprise an amino acid sequence having at least 70% sequence identity to any one of SEQ ID NOs: 341, 343 and 346-347. In some embodiments, the cell comprises cytochrome P450 reductase or a gene encoding cytochrome P450 reductase. In some embodiments, the cell comprises a gene encoding a hydrolase capable of hydrolyzing a first mogroside to produce mogroside IIIE. For example, the hydrolase can be a β-glucan hydrolase. In some embodiments, the hydrolase is EXG1 or EXG2. In some embodiments, the first mogroside is selected from the group consisting of a mogroside IV, a mogroside V, a mogroside VI, a siamenoside I, a mogroside IVE, a mogroside IVA, and combinations thereof. In some embodiments, the cell is a yeast cell. For example, the cell can be *Saccharomyces cerevisiae* or *Yarrowia lipolytica*.

Also disclosed herein include a compound having the structure of compound (1):

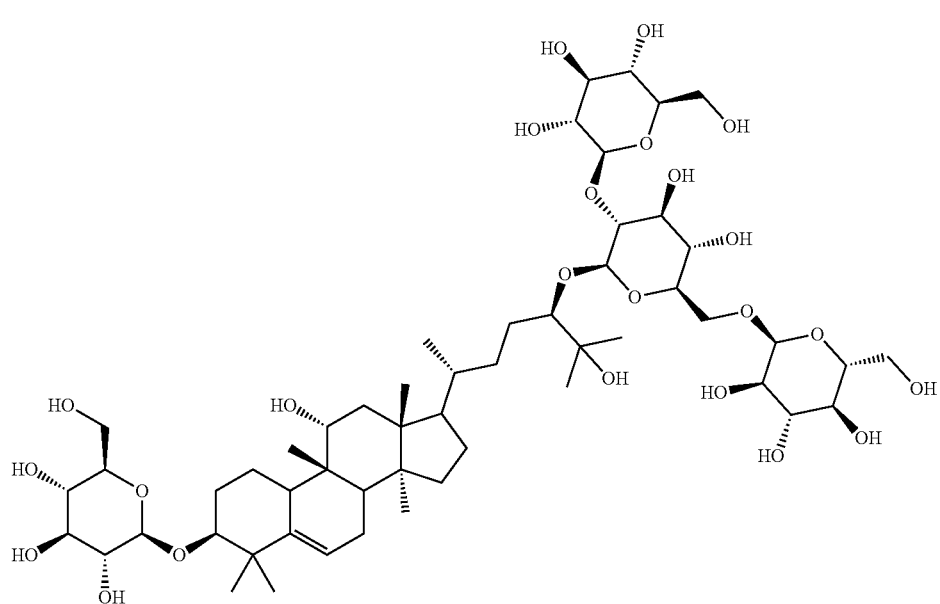

(1)

wherein the compound is in isolated and purified form.

Disclosed herein include a composition, comprising a compound having the structure of compound (1):

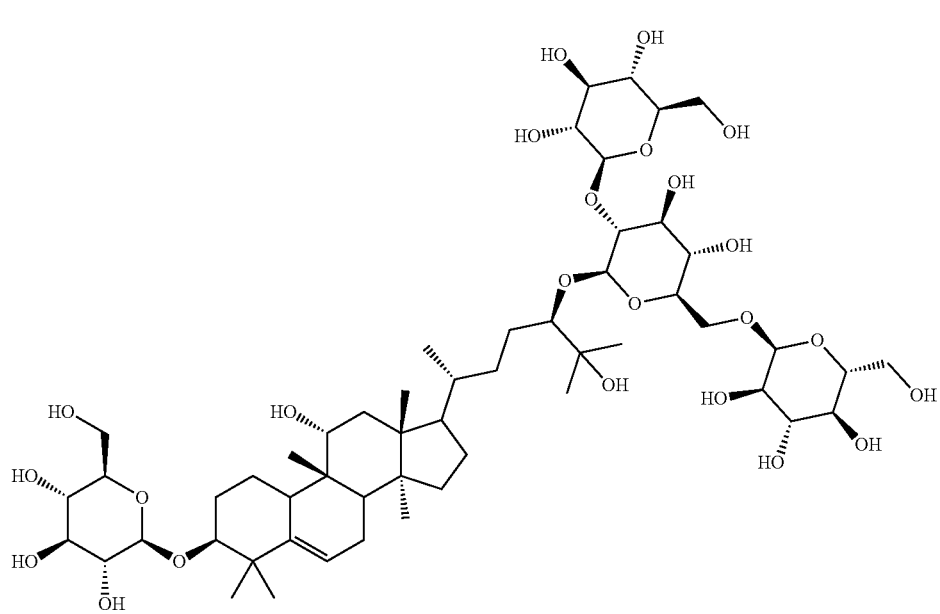

(1)

wherein the composition comprises greater than 50% by weight of the compound.

In some embodiments, the composition comprise less than 1%, 0.5%, or 0.1% by weight of Mogroside IIIE. In some embodiments, the composition comprises less than 0.3%, 0.1%, 0.05%, or 0.01% by weight of 11-oxo-Mogroside III$_E$. In some embodiments, the composition comprises less than 1%, 0.5%, or 0.1% by weight of all isomers of Mogroside I, Mogroside II, and Mogroside III. In some embodiments, the composition comprises less than 0.1% by weight of Mogroside IIIE, 11-oxo-Mogroside IIIE, Mogroside IIIA2, Mogroside IE, and Mogroside IIE. In some embodiments, the composition comprises less than 1%, 0.5%, or 0.1% by weight of 11-oxo-mogrol. In some embodiments, the composition comprises greater than 70%, 80%, or 90% by weight of the compound. In some embodiments, the composition is in solid form.

Also disclosed herein include a composition, comprising a solution of a compound having the structure of compound (1):

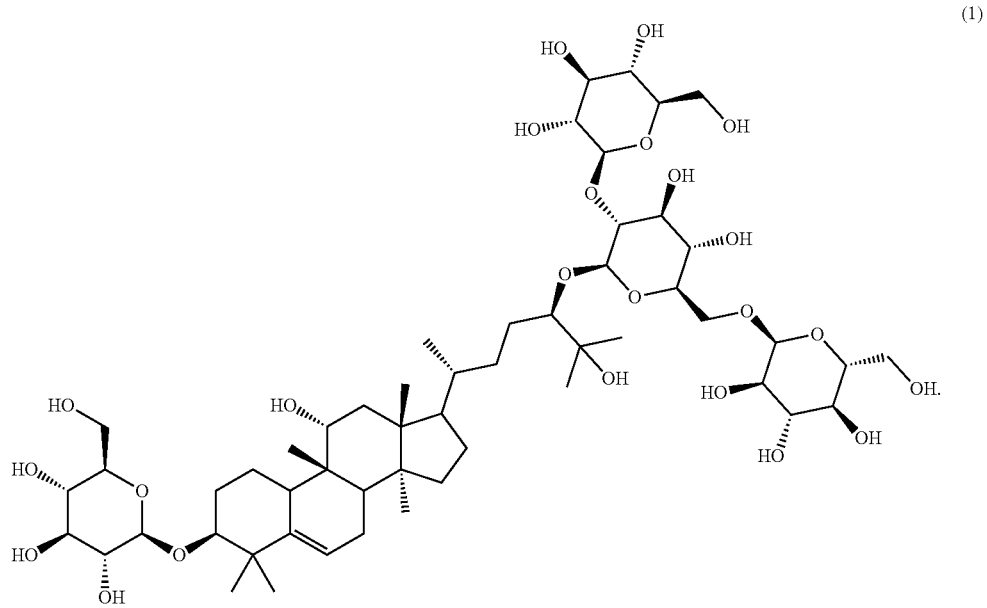 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

In some embodiments, the concentration of the compound in the solution of the embodiment described above is greater than 500 ppm, 0.1%, 0.5%, 1%, 5%, or 10%. In some embodiments, the composition comprises a concentration of Mogroside $III_E$ that is less than 100 ppm, 50 ppm, 20 ppm or 5 ppm. In some embodiments, the composition comprises a concentration of 11-oxo-Mogroside IIIE of less than 30 ppm, 10 ppm, 1 ppm, or 0.1 ppm. In some embodiments, the composition comprises a combined concentration of all isomers of Mogroside I, Mogroside II, and Mogroside III of less than 1%, 0.5%, 0.1%, 500 ppm, or 100 ppm. In some embodiments, the composition comprises a combined concentration of Mogroside IIIE, 11-oxo-Mogroside IIIE, Mogroside IIIA2, Mogroside IE, and Mogroside IIE of less than 500 ppm or 100 ppm. In some embodiments, the composition comprises a concentration of 11-oxo-mogrol of less than 0.5% or 100 ppm.

Enclosed herein include a composition, comprising a bulking agent and one or more compounds having the structure of compound (1):

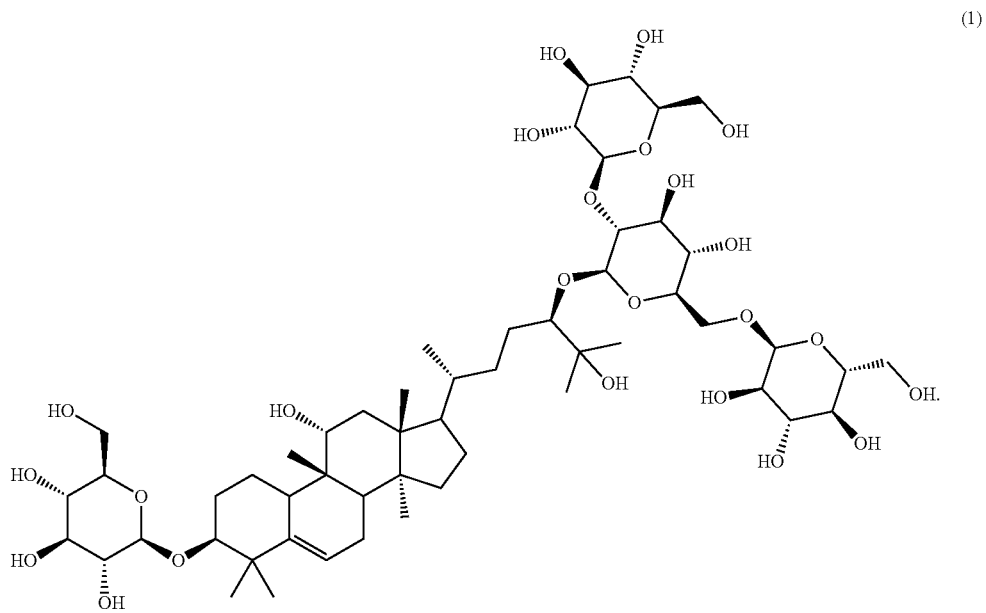 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

In some embodiments, the composition comprises greater than 0.5%, 1%, or 2% by weight of the compound. In some embodiments, the composition comprises greater than 30%, 50%, 70%, 90%, or 99% by weight of the bulking agent. In some embodiments, the composition comprises the compound and at least one additional sweetener and/or sweet modifier.

Also disclosed herein include the use of any of the compositions disclosed herein, for example the composition comprising compound (1) to convey, enhance, modify, or improve the perception of sweetness of a consumable product.

DETAILED DESCRIPTION

Definitions

Figure 1:
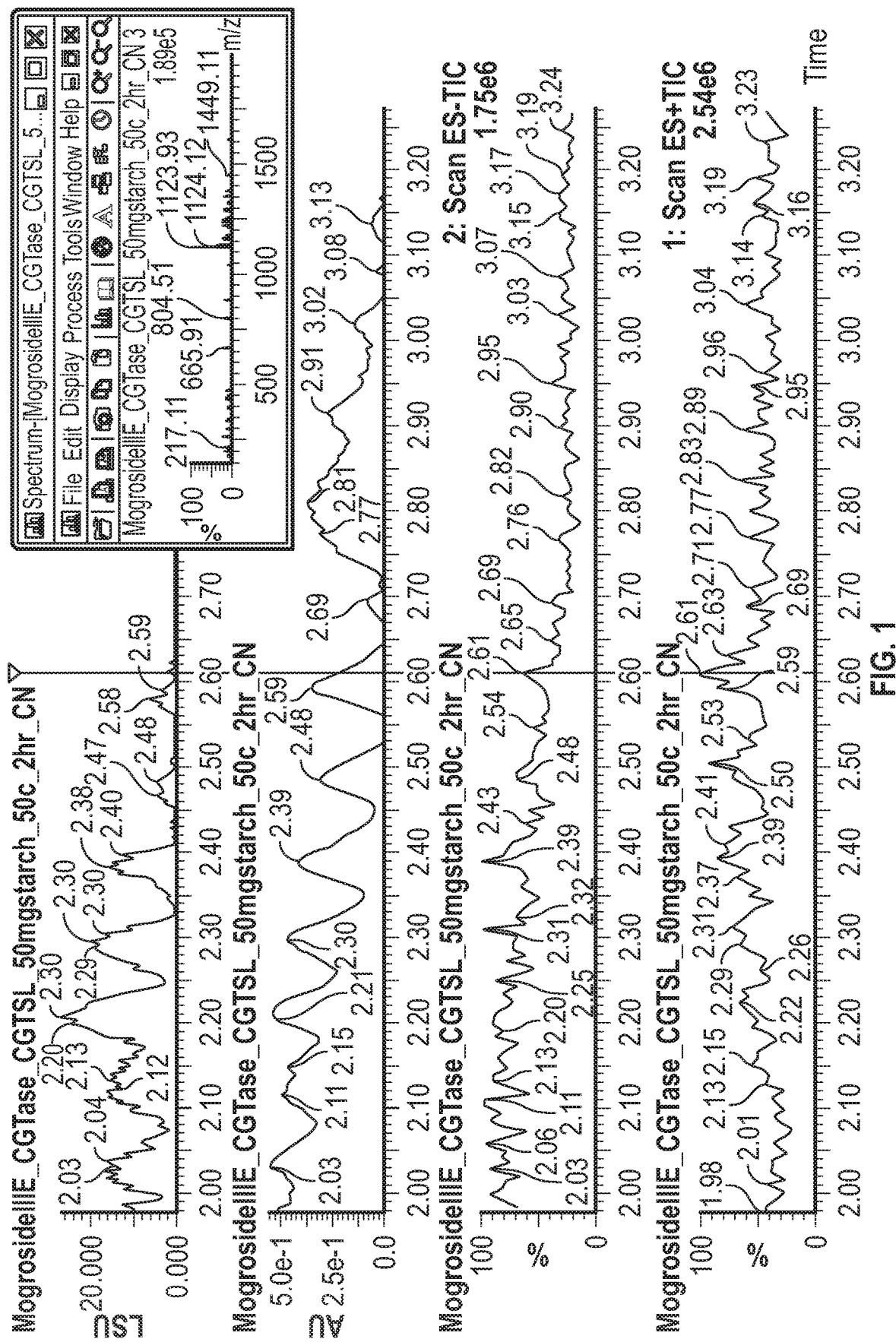
FIG. 1 shows HPLC data and mass spectroscopy data (inset) of Compound 1 production after treatment of Mogroside IIIE with CGTase.

Unless defined otherwise, all technical and scientific terms used herein have the same meaning as is commonly understood by one of ordinary skill in the art to which this disclosure belongs. All patents, applications, published applications, and other publications are incorporated by reference in their entirety. In the event that there is a plurality of definitions for a term herein, those in this section prevail unless stated otherwise.

"Solvate" refers to the compound formed by the interaction of a solvent and a compound described herein or salt thereof. Suitable solvates are physiologically acceptable solvates including hydrates.

A "sweetener", "sweet flavoring agent", "sweet flavor entity", "sweet compound," or "sweet tasting compound," as used herein refers to a compound or physiologically acceptable salt thereof that elicits a detectable sweet flavor in a subject. A "sweet modifier," as used herein refers to a compound or physiologically acceptable salt thereof that enhances, modifies, or improves the perception of sweetness.

As used herein, the term "operably linked" is used to describe the connection between regulatory elements and a gene or its coding region. Typically, gene expression is placed under the control of one or more regulatory elements, for example, without limitation, constitutive or inducible promoters, tissue-specific regulatory elements, and enhancers. A gene or coding region is said to be "operably linked to" or "operatively linked to" or "operably associated with" the regulatory elements, meaning that the gene or coding region is controlled or influenced by the regulatory element.

For instance, a promoter is operably linked to a coding sequence if the promoter effects transcription or expression of the coding sequence.

The term "regulatory element" and "expression control element" are used interchangeably and refer to nucleic acid molecules that can influence the expression of an operably linked coding sequence in a particular host organism. These terms are used broadly to and cover all elements that promote or regulate transcription, including promoters, enhancer sequences, response elements, protein recognition sites, inducible elements, protein binding sequences, 5' and 3' untranslated regions (UTRs), transcriptional start sites, termination sequences, polyadenylation sequences, intrans, core elements required for basic interaction of RNA polymerase and transcription factors, upstream elements, enhancers, response elements (see, e.g., Lewin, "Genes V" (Oxford University Press, Oxford) pages 847-873), and any combination thereof. Exemplary regulatory elements in prokaryotes include promoters, operator sequences and a ribosome binding sites. Regulatory elements that are used in eukaryotic cells can include, without limitation, transcriptional and translational control sequences, such as promoters, enhancers, splicing signals, polyadenylation signals, terminators, protein degradation signals, internal ribosome-entry element (IRES), 2A sequences, and the like, that provide for and/or regulate expression of a coding sequence and/or production of an encoded polypeptide in a host cell. In some embodiments herein, the recombinant cell described herein comprises a genes operably linked to regulatory elements.

As used herein, 2A sequences or elements refer to small peptides introduced as a linker between two proteins, allowing autonomous intraribosomal self-processing of polyproteins (See e.g., de Felipe. Genetic Vaccines and Ther. 2:13 (2004); deFelipe et al. Traffic 5:616-626 (2004)). These short peptides allow co-expression of multiple proteins from a single vector. Many 2A elements are known in the art. Examples of 2A sequences that can be used in the methods and system disclosed herein, without limitation, include 2A sequences from the foot-and-mouth disease virus (F2A), equine rhinitis A virus (E2A), *Thosea asigna* virus (T2A), and porcine teschovirus-1 (P2A) as described in U.S. Patent Publication No. 20070116690.

As used herein, the term "promoter" is a nucleotide sequence that permits binding of RNA polymerase and directs the transcription of a gene. Typically, a promoter is located in the 5' non-coding region of a gene, proximal to the transcriptional start site of the gene. Sequence elements within promoters that function in the initiation of transcription are often characterized by consensus nucleotide sequences. Examples of promoters include, but are not limited to, promoters from bacteria, yeast, plants, viruses, and mammals (including humans). A promoter can be inducible, repressible, and/or constitutive. Inducible promoters initiate increased levels of transcription from DNA under their control in response to some change in culture conditions, such as a change in temperature.

As used herein, the term "enhancer" refers to a type of regulatory element that can increase the efficiency of transcription, regardless of the distance or orientation of the enhancer relative to the start site of transcription.

As used herein, the term "transgene" refers to any nucleotide or DNA sequence that is integrated into one or more chromosomes of a target cell by human intervention. In some embodiment, the transgene comprises a polynucleotide that encodes a protein of interest. The protein-encoding polynucleotide is generally operatively linked to other sequences that are useful for obtaining the desired expression of the gene of interest, such as transcriptional regulatory sequences. In some embodiments, the transgene can additionally comprise a nucleic acid or other molecule(s) that is used to mark the chromosome where it has integrated.

"Percent (%) sequence identity" with respect to polynucleotide or polypeptide sequences is used herein as the percentage of bases or amino acid residues in a candidate sequence that are identical with the bases or amino acid residues in another sequence, after aligning the two sequences. Gaps can be introduced into the sequence alignment, if necessary, to achieve the maximum percent sequence identity. Conservative substitutions are not considered as part of the sequence identity. Alignment for purposes of determining percent (%) sequence identity can be achieved in various ways that are within the skill in the art, for instance, using publicly available computer methods and programs such as BLAST, BLAST-2, ALIGN, FASTA (available in the Genetics Computing Group (GCG) package, from Madison, Wisconsin, USA), or Megalign (DNASTAR). Those of skill in the art can determine appropriate parameters for measuring alignment, including any algorithms needed to achieve maximal alignment over the full length of the sequences being compared.

For instance, percent (%) amino acid sequence identity values may be obtained by using the WU-BLAST-2 computer program described in, for example, Altschul et al., Methods in Enzymology, 1996, 266:460-480. Many search parameters in the WU-BLAST-2 computer program can be adjusted by those skilled in the art. For example, some of the adjustable parameters can be set with the following values: overlap span=1, overlap fraction=0.125, word threshold (T)=11, and scoring matrix=BLOSUM62. When WU-BLAST-2 is used, a % amino acid sequence identity value is determined by dividing (a) the number of matching identical amino acid residues between the amino acid sequence of a first protein of interest and the amino acid sequence of a second protein of interest as determined by WU-BLAST-2 by (b) the total number of amino acid residues of the first protein of interest.

Percent amino acid sequence identity may also be determined using the sequence comparison program NCBI-BLAST2 described in, for example, Altschul et al., Nucleic Acids Res., 1997, 25:3389-3402. The NCBI-BLAST2 sequence comparison program may be downloaded from http://www.ncbi.nlm.nih.gov or otherwise obtained from the National Institute of Health, Bethesda, MD. NCBI-BLAST2 uses several adjustable search parameters. The default values for some of those adjustable search parameters are, for example, unmask=yes, strand=all, expected occurrences=10, minimum low complexity length=15/5, multi-pass e-value=0.01, constant for multi-pass=25, drop-off for final gapped alignment=25 and scoring matrix=BLOSUM62.

In situations where NCBI-BLAST2 is used for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

$$100 \text{ times the fraction } X/Y$$

where X is the number of amino acid residues scored as identical matches by the sequence alignment program NCBI-BLAST2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A.

As used herein, "isolated" means that the indicated compound has been separated from its natural milieu, such that one or more other compounds or biological agents present with the compound in its natural state are no longer present.

As used herein, "purified" means that the indicated compound is present at a higher amount relative to other compounds typically found with the indicated compound (e.g., in its natural environment). In some embodiments, the relative amount of purified a purified compound is increased by greater than 1%, 5%, 10%, 20%, 30%, 40%, 50%, 80%, 90%, 100%, 120%. 150%, 200%, 300%, 400%, or 1000%. In some embodiments, a purified compound is present at a weight percent level greater than 1%, 5%, 10%, 20%, 30%, 40%, 50%, 60%, 70%, 80%, 90%, 95%, 98%, 99%, or 99.5% relative to other compounds combined with the compound. In some embodiments, the compound 1 produced from the embodiments herein is present at a weight percent level greater than 1%, 5%, 10%, 20%, 30%, 40%, 50%, 60%, 70%, 80%, 90%, 95%, 98%, 99%, or 99.5% relative to other compounds combined with the compound after production.

"Purification" as described herein, can refer to the methods for extracting Compound 1 from the cell lysate and/or the supernatant, wherein the cell is excreting the product of Compound 1. "Lysate" as described herein, comprises the cellular content of a cell after disruption of the cell wall and cell membranes and can include proteins, sugars, and mogrosides, for example. Purification can involve ammonium sulfate precipitation to remove proteins, salting to remove proteins, hydrophobic separation (HPLC), and use of an affinity column. In view of the products produced by the methods herein, affinity media is contemplated for the removal of specific mogrosides with an adsorbent resin.

"HPLC" as described herein is a form of liquid chromatography that can be used to separate compounds that are dissolved in solution. Without being limiting the HPLC instruments can comprise of a reservoir of mobile phase, a pump, an injector, a separation column, and a detector. Compounds can then be separated by injecting a sample mixture onto the column. The different components in the mixture pass can pass through the column at different rates due to differences in their partitioning behavior between the mobile liquid phase and the stationary phase. There are several columns that can be used. Without being limiting the columns can be normal phase columns, reverse phase columns, size exclusion type of columns, and ion exchange columns.

Also contemplated is the use of solid phase extraction and fractionation, which is useful for desalting proteins and sugar samples. Other methods can include the use of HPLC, liquid chromatography for analyzing samples, and liquid-liquid extraction, described in Aura Andrade-Eiroa et al. (TrAC Trends in Analytical Chemistry Volume 80, June 2016, Pages 641-654; incorporated by reference in its entirety herein.

"Solid phase extraction" (SPE) for purification, as described herein, refers to a sample preparation process in which compounds that are dissolved or suspended in a liquid mixture are separated from other compounds in the mixture according to their physical and chemical properties. For example, analytical laboratories can use solid phase extraction to concentrate and purify samples for analysis. Solid phase extraction can also be used to isolate analytes of interest from a wide variety of matrices, including urine, blood, water, beverages, soil, and animal tissue, for example. In the embodiments herein, Compound 1 that is in cell lysate or in the cell media can be purified by solid phase extraction.

SPE uses the affinity of solutes dissolved or suspended in a liquid (known as the mobile phase) for a solid through which the sample is passed (known as the stationary phase) to separate a mixture into desired and undesired components. SPE can also be used and applied directly in gas-solid phase and liquid-solid phase, or indirectly to solid samples by using, e.g., thermodesorption with subsequent chromatographic analysis. This can result in either the desired analytes of interest or undesired impurities in the sample are retained on the stationary phase. The portion that passes through the stationary phase can be collected or discarded, depending on whether it contains the desired analytes or undesired impurities. If the portion retained on the stationary phase includes the desired analytes, they can then be removed from the stationary phase for collection in an additional step, in which the stationary phase is rinsed with an appropriate eluent.

Ways that the solid phase extraction can be performed are not limited. Without being limiting, the procedures may include: Normal phase SPE procedure, Reversed phase SPE, Ion exchange SPE, Anion exchange SPE, Cation exchange, and Solid-phase microextraction. Solid phase extraction is described in Sajid et al., and Płotka-Wasylka J et al. (Anal Chim Acta. 2017 May 1; 965:36-53, Crit Rev Anal Chem. 2017 Apr. 11:1-11; incorporated by reference in its entirety).

In some embodiments, the compound 1 that is produced by the cell is purified by solid phase extraction. In some embodiments, the purity of compound 1, for example purified by solid phase extraction is 70%, 80%, 90% or 100% pure or any level of purity defined by any aforementioned values.

"Fermentation" as described herein, refers broadly to the bulk growth of host cells in a host medium to produce a specific product. In the embodiments herein, the final product produced is Compound 1. This can also include methods that occur with or without air and can be carried out in an anaerobic environment, for example. The whole cells (recombinant host cells) may be in fermentation broth or in a reaction buffer.

Compound 1 and intermediate mogroside compounds for the production of Compound 1 can be isolated by collection of intermediate mogroside compounds and Compound 1 from the recombinant cell lysate or from the supernatant. The lysate can be obtained after harvesting the cells and subjecting the cells to lysis by shear force (French press cell or sonication) or by detergent treatment. The lysate can then be filtered and treated with ammonium sulfate to remove proteins, and fractionated on a C18 HPLC (5×10 cm Atlantis prep T3 OBD column, 5 um, Waters) and by injections using an A/B gradient (A=water B=acetonitrile) of 10→30% B over 30 minutes, with a 95% B wash, followed by re-equilibration at 1% (total run time=42 minutes). The runs can be collected in tared tubes (12 fractions/plate, 3 plates per run) at 30 mL/fraction. The lysate can also be centrifuged to remove solids and particulate matter.

Plates can then be dried in the Genevac HT12/HT24. The desired compound is expected to be eluted in Fraction 21 along with other isomers. The pooled Fractions can be further fractionated in 47 runs on fluoro-phenyl HPLC column (3×10 cm, Xselect fluoro-phenyl OBD column, 5 um, Waters) using an A/B gradient (A=water, B=acetonitrile) of 15→30% B over 35 minutes, with a 95% B wash, followed by re-equilibration at 15% (total run time=45 minutes). Each run was collected in 12 tared tubes (12 fractions/plate, 1 plate per run) at 30 mL/fraction. Fractions containing the desired peak with the desired purity can be pooled based on UPLC analysis and dried under reduced pressure to give a whitish powdery solid. The pure compound can be re-suspended/dissolved in 10 mL of water and lyophilized to obtain at least a 95% purity.

As used herein, a "glycosidic bond" refers to a covalent bond connecting two furanose and/or pyranose groups together. Generally, a glycosidic bond is the bond between the anomeric carbon of one furanose or pyranose moiety and an oxygen of another furanose or pyranose moiety. Glycosidic bonds are named using the numbering of the connected carbon atoms, and the alpha/beta orientation. α- and β-glycosidic bonds are distinguished based on the relative stereochemistry of the anomeric position and the stereocenter furthest from C1 in the ring. For example, sucrose is a disaccharide composed of one molecule of glucose and one molecule of fructose connected through an alpha 1-2 glycosidic bond, as shown below.

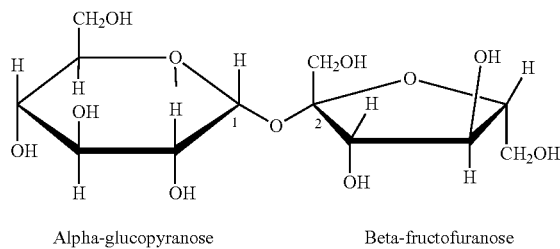

Alpha-glucopyranose      Beta-fructofuranose

An example of a beta 1-4 glycosidic bond can be found in cellulose:

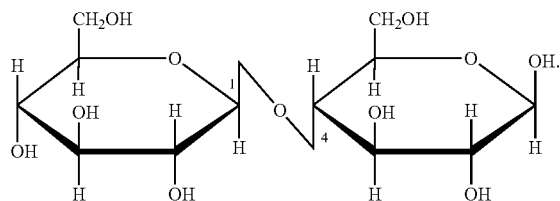

As used in the specification and the appended claims, the singular forms "a," "an" and "the" include plural referents unless the context clearly dictates otherwise. Thus, for example, reference to "an aromatic compound" includes mixtures of aromatic compounds.

Often, ranges are expressed herein as from "about" one particular value, and/or to "about" another particular value. When such a range is expressed, another embodiment includes from the one particular value and/or to the other particular value. Similarly, when values are expressed as approximations, by use of the antecedent "about," it will be understood that the particular value forms another embodiment. It will be further understood that the endpoints of each of the ranges are significant both in relation to the other endpoint, and independently of the other endpoint.

"Codon optimization" as described herein, refers to the design process of altering codons to codons known to increase maximum protein expression efficiency. In some alternatives, codon optimization for expression in a cell is described, wherein codon optimization can be performed by using algorithms that are known to those skilled in the art so as to create synthetic genetic transcripts optimized for high mRNA and protein yield in humans. Codons can be optimized for protein expression in a bacterial cell, mammalian cell, yeast cell, insect cell, or plant cell, for example. Programs containing algorithms for codon optimization in humans are readily available. Such programs can include, for example, OptimumGene™ or GencGPS® algorithms. Additionally codon optimized sequences can be obtained commercially, for example, from Integrated DNA Technologies. In some of the embodiments herein, a recombinant cell for the production of Compound 1 comprises genes encoding enzymes for synthesis, wherein the genes are codon optimized for expression. In some embodiments, the genes are codon optimized for expression in bacterial, yeast, fungal or insect cells.

As used herein, the terms "nucleic acid," "nucleic acid molecule," and "polynucleotide" are interchangeable and refer to any nucleic acid, whether composed of phosphodiester linkages or modified linkages such as phosphotriester, phosphoramidate, siloxane, carbonate, carboxymethylester, acetamidate, carbamate, thioether, bridged phosphoramidate, bridged methylene phosphonate, bridged phosphoramidate, bridged phosphoramidate, bridged methylene phosphonate, phosphorothioate, methylphosphonate, phosphorodithioate, bridged phosphorothioate or sultone linkages, and combinations of such linkages. The terms "nucleic acid" and "polynucleotide" also specifically include nucleic acids composed of bases other than the five biologically occurring bases (adenine, guanine, thymine, cytosine and uracil).

Non-limiting examples of polynucleotides include deoxyribonucleic acid (DNA) or ribonucleic acid (RNA), oligonucleotides, fragments generated by the polymerase chain reaction (PCR), and fragments generated by any of ligation, scission, endonuclease action, and exonuclease action. Nucleic acid molecules can be composed of monomers that are naturally-occurring nucleotides (such as DNA and RNA), or analogs of naturally-occurring nucleotides (e.g., enantiomeric forms of naturally-occurring nucleotides), or a combination of both. Modified nucleotides can have alterations in sugar moieties and/or in pyrimidine or purine base moieties. Sugar modifications include, for example, replacement of one or more hydroxyl groups with halogens, alkyl groups, amines, and azido groups, or sugars can be functionalized as ethers or esters. Moreover, the entire sugar moiety can be replaced with sterically and electronically similar structures, such as aza-sugars and carbocyclic sugar analogs. Examples of modifications in a base moiety include alkylated purines and pyrimidines, acylated purines or pyrimidines, or other well-known heterocyclic substitutes. Nucleic acid monomers can be linked by phosphodiester bonds or analogs of such linkages. Analogs of phosphodiester linkages include phosphorothioate, phosphorodithioate, phosphoroselenoate, phosphorodiselenoate, phosphoroanilothioate, phosphoranilidate, phosphoramidate, and the like. The term "nucleic acid molecule" also includes so-called "peptide nucleic acids," which comprise naturally-occurring or modified nucleic acid bases attached to a polyamide backbone. Nucleic acids can be either single stranded or double stranded. In some alternatives, a nucleic acid sequence encoding a fusion protein is provided. In some alternatives, the nucleic acid is RNA or DNA. In some embodiments, the nucleic acid comprises any one of SEQ ID NOs: 1-1023.

"Coding for" or "encoding" are used herein, and refers to the property of specific sequences of nucleotides in a polynucleotide, such as a gene, a cDNA, or an mRNA, to serve as templates for synthesis of other macromolecules such as a defined sequence of amino acids. Thus, a gene codes for a protein if transcription and translation of mRNA corresponding to that gene produces the protein in a cell or other biological system. In some embodiments herein, a recombinant cell is provided, wherein the recombinant cell comprises genes encoding for enzymes such as dextransucrase, UDP glycosyltransferases, CGTases, glycotransferases, dextransucrases, cellulases, β-glucosidases, amylases, transglucosidases, pectinases, dextranases, and/or UGT. In some embodiments, the transglucosidases comprises an amino acid sequence set forth by any one of SEQ ID NOs: 163-290 and 723. In some embodiments, the CGTases are encoded by or have the sequence of any one of SEQ ID NOs: 1, 3, 78-101, 147 and 154. In some embodiments, the genes encoding the enzymes such as dextransucrase, UDP glycosyltransferases, CGTases, glycotransferases, dextransucrases, cellulases, β-glucosidases, amylases, transglucosidases, pectinases, dextranases, and/or UGT are codon optimized for expression in the host cell. A "nucleic acid sequence coding for a polypeptide" includes all nucleotide sequences that are degenerate versions of each other and that code for the same amino acid sequence.

Optimization can also be performed to reduce the occurrence of secondary structure in a polynucleotide. In some alternatives of the method, optimization of the sequences in the vector can also be performed to reduce the total GC/AT ratio. Strict codon optimization can lead to unwanted secondary structure or an undesirably high GC content that leads to secondary structure. As such, the secondary structures affect transcriptional efficiency. Programs such as GeneOptimizer can be used after codon usage optimization, for secondary structure avoidance and GC content optimization. These additional programs can be used for further optimization and troubleshooting after an initial codon optimization to limit secondary structures that can occur after the first round of optimization. Alternative programs for optimization are readily available. In some alternatives of the method, the vector comprises sequences that are optimized for secondary structure avoidance and/or the sequences are optimized to reduce the total GC/AT ratio and/or the sequences are optimized for expression in a bacterial or yeast cell.

"Vector," "Expression vector" or "construct" is a nucleic acid used to introduce heterologous nucleic acids into a cell that has regulatory elements to provide expression of the heterologous nucleic acids in the cell. Vectors include but are not limited to plasmid, minicircles, yeast, and viral genomes. In some alternatives, the vectors are plasmid, minicircles, yeast, or genomes. In some alternatives, the vector is for protein expression in a bacterial system such as *E. coli*. In some alternatives, the vector is for protein expression in a bacterial system, such as *E. coli*. In some alternatives, the vector is for protein expression in a yeast system. In some embodiments, the vector for expression is a viral vector. In some embodiments the vector is a recombinant vector comprising promoter sequences for upregulation of expression of the genes. "Regulatory elements" can refer to the nucleic acid that has nucleotide sequences that can influence the transcription or translation initiation and rate, stability and mobility of a transcription or translation product.

"Recombinant host" or "recombinant host cell" as described herein is a host, the genome of which has been augmented by at least one incorporated DNA sequence. Said incorporated DNA sequence may be a heterologous nucleic acid encoding one or more polypeptides. Such DNA sequences include but are not limited to genes that are not naturally present, DNA sequences that are not normally transcribed into RNA or translated into a protein ("expressed"), and other genes or DNA sequences which one desires to introduce into the nonrecombinant host. In some embodiments, the recombinant host cell is used to prevent expression problems such as codon-bias. There are commercial hosts for expression of proteins, for example, BL21-CodonPlus™ cells, tRNA-Supplemented Host Strains for Expression of Heterologous Genes, Rosetta™ (DE3) competent strains for enhancing expression of proteins, and commercial yeast expression systems in the genera *Saccharomyces, Pichia, Kluyveromyces, Hansenula* and *Yarrowia*.

The recombinant host may be a commercially available cell such as Rosetta cells for expression of enzymes that may have rare codons.

In some embodiments, the recombinant cell comprises a recombinant gene for the production of cytochrome P450 polypeptide comprising the amino acid sequence of any one of CYP533, CYP937, CYP1798, CYP1994, CYP2048, CYP2740, CYP3404, CYP3968, CYP4112, CYP4149, CYP4491, CYP5491, CYP6479, CYP7604, CYP8224, CYP8728, CYP10020, and CYP10285. In some embodiments, the P450 polypeptide is encoded in genes comprising any one of the sequences set forth in SEQ ID Nos: 31-48, 316, 431, 871, 873, 875, 877, 879, 881, 883, 885, 887, and 891.

In some embodiments, the P450 enzyme is aided by at least one CYP activator, such as CPR4497. In some embodiments, the recombinant host cell further comprises a gene encoding CPR4497, wherein the gene comprises a nucleic acid sequence set forth in SEQ ID NO: 112. In some embodiments, the recombinant host cell further comprises a gene encoding CPR4497, wherein the amino acid sequence of CPR4497 is set forth in SEQ ID NO: 113.

In some embodiments, wherein the recombinant host cell is a yeast cell, the recombinant cell has a deletion of EXG1 gene and/or the EXG2 gene to prevent reduction of glucanase activity which may lead to deglucosylation of mogrosides.

The type of host cell can vary. For example, the host cell can be selected from a group consisting of *Agaricus, Aspergillus, Bacillus, Candida, Corynebacterium, Escherichia, Fusarium/Gibberella, Kluyveromyces, Laetiporus, Lentinus, Phaffia, Phanerochaete, Pichia, Physcomitrella, Rhodoturula, Saccharomyces, Schizosaccharomyces, Sphaceloma, Xanthophyllomyces, Yarrowia, Lentinus tigrinus, Laetiporus sulphureus, Phanerochaete chrysosporium, Pichia pastoris, Physcomitrella patens, Rhodoturula glutinis, Rhodoturula mucilaginosa, Phaffia rhodozyma, Xanthophyllomyces dendrorhous, Fusarium fujikuroi/Gibberella fujikuroi, Candida utilis, Yarrowia lipolytica, Siraitia, Momordica, Gynostemma, Cucurbita, Cucumis, Arabidopsis, Artemisia, Stevia, Panax, Withania, Euphorbia, Medicago, Chlorophytum, Eleutherococcus, Aralia, Morus, Medicago, Betula, Astragalus, Jatropha, Camellia, Hypholoma, Aspergillus, Solanum, Huperzia, Pseudostellaria, Corchorus, Hedera, Marchantia,* and *Morus, Trichophyton, Sanghuangporus, Taiwanofungus, Moniliophthora, Marssonina, Diplodia, Lentinula, Xanthophyllomyces, Pochonia, Colletotrichum, Diaporthe, Histoplasma, Coccidioides, Histoplasma, Sanghuangporus, Aureobasidium, Pochonia, Penicillium, Sporothrix, Metarhizium, Aspergillus, Yarrowia, Lipomyces, Aspergillus nidulans, Yarrowia lipolytica, Rhodosporin toruloides, Candida, Sacccharaomyces, Saccharomycotina, Taphrinomycotina, Schizosaccharomyceses, Komagataella, Basidiomycota, Agaricomycotina, Tremellomycetes, Puccin-*

*iomycotina, Aureobasidium, Coniochaeta, Rhodosporidium,* and *Microboryomycetes, Gibberella fujikuroi, Kluyveromyces lactis, Schizosaccharomyces pombe, Aspergillus niger, Saccharomyces cerevisiae, Escherichia coli, Rhodobacter sphaeroides,* and *Rhodobacter capsulatus.* Methods to enhance product yield have been described, for example, in *S. cerevisiae.* Methods are known for making recombinant microorganisms.

Methods to prepare recombinant host cells from *Aspergillus* spp. is described in WO2014086842, incorporated by reference in its entirety herein. Nucleotide sequences of the genomes can be obtained through gene data libraries available publicly and can allow for rational design and modifications of the pathways to enhance and improve product yield.

"Culture media" as described herein, can be a nutrient rich broth for the growth and maintenance of cells during their production phase. A yeast culture for maintaining and propagating various strains, can require specific formulations of complex media for use in cloning and protein expression, and can be appreciated by those of skill in the art. Commercially available culture media can be used from ThermoFisher for example. The media can be YPD broth or can have a yeast nitrogen base. Yeast can be grown in YPD or synthetic media at 30° C.

Lysogeny broth (LB) is typically used for bacterial cells. The bacterial cells used for growth of the enzymes and mogrosides can have antibiotic resistance to prevent the growth of other cells in the culture media and contamination. The cells can have an antibiotic gene cassettes for resistance to antibiotics such as chloramphenicol, penicillin, kanamycin and ampicillin, for example.

As described herein, a "fusion protein" is a protein created through the joining of two or more nucleic acid sequences that originally coded for a portion or entire amino acid sequence of separate proteins. For example, a fusion protein can contain a functional protein (e.g., an enzyme (including, but not limited to, cucurbitadienol synthase)) and one or more fusion domains. A fusion domain, as describe herein, can be a full length or a portion/fragment of a protein (e.g., a functional protein including but not limited to, an enzyme, a transcription factor, a toxin, and translation factor). The location of the one or more fusion domains in the fusion protein can vary. For example, the one or more fusion domains can be at the N- and/or C-terminal regions (e.g., N- and/or C-termini) of the fusion protein. The one or more fusion domains can also be at the central region of the fusion protein. The fusion domain is not required to be located at the terminus of the fusion protein. A fusion domain can be selected so as to confer a desired property. For example, a fusion domain may affect (e.g., increase or decrease) the enzymatic activity of an enzyme that it is fused to, or affect (e.g., increase or decrease) the stability of a protein that it is fused to. A fusion domain may be a multimerizing (e.g., dimerizing and tetramerizing) domain and/or functional domains. In some embodiments, the fusion domain may enhance or decrease the multimerization of the protein that it is fused to. As a non-limiting example, a fusion protein can contain a full length protein A and a fusion domain fused to the N-terminal region and/or C-terminal region of the full length protein A. In some examples, a fusion protein contains a partial sequence of protein A and a fusion domain fused to the N-terminal region and/or C-terminal region (e.g., the N-terminus and C-terminus) of the partial sequence of protein A. The fusion domain can be, for example, a portion or the entire sequence of protein A, or a portion or the entire sequence of a protein different from protein A. In some embodiments, one or more of the enzymes suitable for use in the methods, systems and compositions disclosed herein can be a fusion protein.

The length of the fusion domain can vary, for example, from 3, 4, 5, 6, 7, 8, 9, 10, 12, 15, 20, 25, 30, 40, 50, 60, 70, 80, 90, 100, 125, 150, 200, 300, 400, 500, 600, 700, 800, 900, 1000, 1100, 1200, 1300, 1400, 1500, or a range between any of these two numbers, amino acids. In some embodiments, the fusion domain is about 3, 4, 5, 5, 6, 7, 8, 9, 10, 12, 15, 20, 25, 30, 40, 50, or a range between any two of these numbers, amino acids in length. In some embodiments, the fusion domain is a substantial portion or the entire sequence of a functional protein (for example, an enzyme, a transcription factor, or a translation factor). In some embodiments, the fusion protein is a protein having cucurbitadienol synthase activity.

Optimizing cell growth and protein expression techniques in culture media are also contemplated. For growth in culture media, cells such as yeast can be sensitive to low pH (Narendranath et al., Appl Environ Microbiol. 2005 May; 71(5): 2239-2243; incorporated by reference in its entirety). During growth, yeast must maintain a constant intracellular pH. There are many enzymes functioning within the yeast cell during growth and metabolism. Each enzyme works best at its optimal pH, which is acidic because of the acidophilic nature of the yeast itself. When the extracellular pH deviates from the optimal level, the yeast cell needs to invest energy to either pump in or pump out hydrogen ions in order to maintain the optimal intracellular pH. As such media containing buffers to control for the pH would be optimal. Alternatively, the cells can also be transferred into a new media if the monitored pH is high.

Growth optimization of bacterial and yeast cells can also be achieved by the addition of nutrients and supplements into a culture media. Alternatively, the cultures can be grown in a fermenter designed for temperature, pH control and controlled aeration rates. Dissolved oxygen and nitrogen can flowed into the media as necessary.

The term "Operably linked" as used herein refers to functional linkage between a regulatory sequence and a heterologous nucleic acid sequence resulting in expression of the latter.

"Mogrosides" and "mogroside compounds" are used interchangeably herein and refer to a family of triterpene glycosides. Non-limiting exemplary examples of mogrosides include such as Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III, which have been identified from the fruits of *Siraitia grosvenorii* (Swingle) that are responsible for the sweetness of the fruits. In the embodiments herein, mogroside intermediates can be used in the in vivo, ex vivo, or in vitro production of Compound 1 having the structure of:

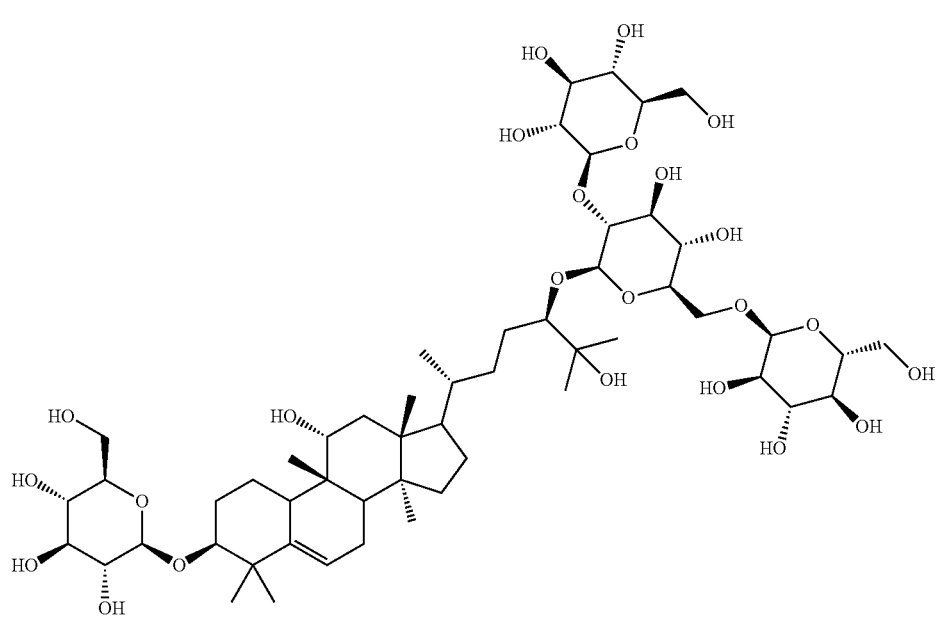

(1)

In some embodiments, a recombinant cell for producing Compound 1, further produces mogrosides and comprises genes encoding enzymes for the production of mogrosides. Recombinant cells capable of the production of mogrosides are further described in WO2014086842, incorporated by reference in its entirety herein. In some embodiments, the recombinant cell is grown in a media to allow expression of the enzymes and production of Compound 1 and mogroside intermediates. In some embodiments, Compound 1 is obtained by lysing the cell with shear force (i.e. French press cell or sonication) or by detergent lysing methods. In some embodiments, the cells are supplemented in the growth media with precursor molecules such as mogrol to boost production of Compound 1.

"Promoter" as used herein refers to a nucleotide sequence that directs the transcription of a structural gene. In some alternatives, a promoter is located in the 5' non-coding region of a gene, proximal to the transcriptional start site of a structural gene. Sequence elements within promoters that function in the initiation of transcription are often characterized by consensus nucleotide sequences. Without being limiting, these promoter elements can include RNA polymerase binding sites, TATA sequences, CAAT sequences, differentiation-specific elements (DSEs; McGehee et al., Mol. Endocrinol. 7:551 (1993); hereby expressly incorporated by reference in its entirety), cyclic AMP response elements (CREs), serum response elements (SREs; Treisman et al., Seminars in Cancer Biol. 1:47 (1990); incorporated by reference in its entirety), glucocorticoid response elements (GREs), and binding sites for other transcription factors, such as CRE/ATF (O'Reilly et al., J. Biol. Chem. 267:19938 (1992); incorporated by reference in its entirety), AP2 (Ye et al., J. Biol. Chem. 269:25728 (1994); incorporated by reference in its entirety), SP1, cAMP response element binding protein (CREB; Loeken et al., Gene Expr. 3:253 (1993); hereby expressly incorporated by reference in its entirety) and octamer factors (see, in general, Watson et al., eds., Molecular Biology of the Gene, 4th ed. (The Benjamin/Cummings Publishing Company, Inc. 1987; incorporated by reference in its entirety)), and Lemaigre and Rousseau, Biochem. J. 303:1 (1994); incorporated by reference in its entirety). As used herein, a promoter can be constitutively active, repressible or inducible. If a promoter is an inducible promoter, then the rate of transcription increases in response to an inducing agent. In contrast, the rate of transcription is not regulated by an inducing agent if the promoter is a constitutive promoter.

A "ribosome skip sequence" as described herein refers to a sequence that during translation, forces the ribosome to "skip" the ribosome skip sequence and translate the region after the ribosome skip sequence without formation of a peptide bond. Several viruses, for example, have ribosome skip sequences that allow sequential translation of several proteins on a single nucleic acid without having the proteins linked via a peptide bond. As described herein, this is the "linker" sequence. In some alternatives of the nucleic acids provided herein, the nucleic acids comprise a ribosome skip sequence between the sequences for the genes for the enzymes described herein, such that the proteins are co-expressed and not linked by a peptide bond. In some alternatives, the ribosome skip sequence is a P2A, T2A, E2A or F2A sequence. In some alternatives, the ribosome skip sequence is a T2A sequence.

Compound 1

As disclosed herein, Compound 1 is a compound having the structure of:

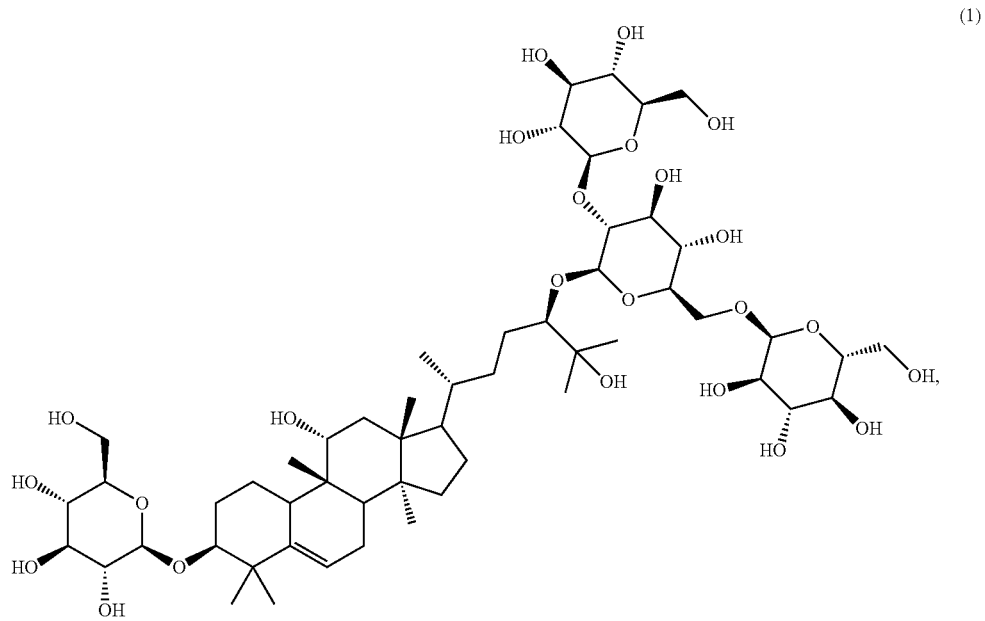 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

or a salt thereof.

Compound 1 is a high-intensity sweetener the can be used in a wide variety of products in which a sweet taste is desired. Compound 1 provides a low-calorie advantage to other sweeteners such as sucrose or fructose.

In some embodiments, Compound 1 is in an isolated and purified form. In some embodiments, Compound 1 is present in a composition in which Compound 1 is substantially purified.

In some embodiments, Compound 1 or salts thereof are isolated and is in solid form. In some embodiments, the solid form is amorphous. In some embodiments, the solid form is crystalline. In some embodiments, the compound is in the form of a lyophile. In some embodiments, Compound 1 is isolated and within a buffer.

The skilled artisan will recognize that some structures described herein may be resonance forms or tautomers of compounds that may be fairly represented by other chemical structures, even when kinetically; the artisan recognizes that such structures may only represent a very small portion of a sample of such compound(s). Such compounds are considered within the scope of the structures depicted, though such resonance forms or tautomers are not represented herein.

Isotopes may be present in Compound 1. Each chemical element as represented in a compound structure may include any isotope of said element. For example, in a compound structure a hydrogen atom may be explicitly disclosed or understood to be present in the compound. At any position of the compound that a hydrogen atom may be present, the hydrogen atom can be any isotope of hydrogen, including but not limited to hydrogen-1 (protium) and hydrogen-2 (deuterium). Thus, reference herein to a compound encompasses all potential isotopic forms unless the context clearly dictates otherwise. In some embodiments, compounds described herein are enriched in one or more isotopes relative to the natural prevalence of such isotopes. In some embodiments, the compounds described herein are enriched in deuterium. In some embodiments, greater than 0.0312% of hydrogen atoms in the compounds described herein are deuterium. In some embodiments, greater than 0.05%, 0.08%, or 0.1% of hydrogen atoms in the compounds described herein are deuterium.

In some embodiments, Compound 1 is capable of forming acid and/or base salts by virtue of the presence of amino and/or carboxyl groups or groups similar thereto.

In some embodiments, Compound 1 is substantially isolated. In some embodiments, Compound 1 is substantially purified. In some embodiments, the compound is in the form of a lyophile. In some embodiments, the compound is crystalline. In some embodiments, the compound is amorphous.

Production Compositions

In some embodiments, the production composition contains none, or less than a certain amount, of undesirable compounds. In some embodiments, the composition contains, or does not contain, one or more isomers of Mogroside I, Mogroside II, and Mogroside III. In some embodiments, the composition contains a weight percent of less than 5%, 3%, 2%, 1%, 0.5%, 0.3%, 0.1%, 800 ppm, 500 ppm, 200 ppm, or 100 ppm of all isomers of Mogroside I, Mogroside II, and Mogroside III. In some embodiments, the composition contains, or does not contain, one or more of Mogroside IIIE, 11-oxo-Mogroside IIIE, Mogroside IIIA2, Mogroside IE, Mogroside IIE, and 11-oxo-mogrol. In some embodiments, the composition contains a weight percent of less than 5%, 3%, 2%, 1%, 0.5%, 0.3%, 0.1%, 800 ppm, 500 ppm, 200 ppm, or 100 ppm of one or more of Mogroside IIIE, 11-oxo-Mogroside IIIE, Mogroside IIIA2, Mogroside IE, Mogroside IIE, and 11-oxo-mogrol. In some embodiments, the composition contains a weight percent of less than 5%, 3%, 2%, 1%, 0.5%, 0.3%, 0.1%, 800 ppm, 500 ppm, 200 ppm, or 100 ppm of Mogroside IIIE. In some embodiments, the composition contains a weight percent of less than 5%, 3%, 2%, 1%, 0.5%, 0.3%, 0.1%, 800 ppm, 500 ppm, 200 ppm, or 100 ppm of 11-oxo-Mogroside IIIE. In some embodiments, the composition contains a weight percent of less than 5%, 3%, 2%, 1%, 0.5%, 0.3%, 0.1%, 800 ppm, 500 ppm, 200 ppm, or 100 ppm of 11-oxo-mogrol.

In some embodiments, the production composition is in solid form, which may by crystalline or amorphous. In some embodiments, the composition is in particulate form. The solid form of the composition may be produced using any suitable technique, including but not limited to re-crystallization, filtration, solvent evaporation, grinding, milling, spray drying, spray agglomeration, fluid bed agglomeration, wet or dry granulation, and combinations thereof. In some embodiments, a flowable particulate composition is provided to facilitate use in further food manufacturing processes. In some such embodiments, a particle size between 50 μm and 300 μm, between 80 μm and 200 μm, or between 80 μm and 150 μm is generated.

Some embodiments provide a production composition comprising Compound 1 that is in solution form. For example, in some embodiments a solution produced by one of the production processes described herein is used without further purification. In some embodiments, the concentration of Compound 1 in the solution is greater than 300 ppm, 500 ppm. 800 ppm, 0.1%, 0.5%, 1%, 2%, 3%, 4%, 5%, 6%, 7%, 8%, 9%, 10%, 15%, or 20% by weight. In some embodiments, the concentration of all isomers of Mogroside I, Mogroside II, and Mogroside III is less than 5%, 3%, 2%, 1%, 0.5%, 0.3%, 0.1%, 800 ppm, 500 ppm, 200 ppm, or 100 ppm. In some embodiments, the concentration of one or more of Mogroside IIIE, 11-oxo-Mogroside IIIE, Mogroside IIIA2, Mogroside IE, Mogroside IIE, and 11-oxo-mogrol in the production composition is less than 5%, 3%, 2%, 1%, 0.5%, 0.3%, 0.1%, 800 ppm, 500 ppm, 200 ppm, 100 ppm. 50 ppm, 30 ppm, 20 ppm, 10 ppm, 5 ppm, 1 ppm, or 0.1 ppm of one or more of Mogroside IIIE, 11-oxo-Mogroside IIIE, Mogroside IIIA2, Mogroside IE, Mogroside IIE, and 11-oxo-mogrol. In some embodiments, the concentration of Mogroside IIIE is less than 5%, 3%, 2%, 1%, 0.5%, 0.3%, 0.1%, 800 ppm, 500 ppm, 200 ppm, 100 ppm, 50 ppm, 30 ppm, 20 ppm, 10 ppm, 5 ppm, 1 ppm, or 0.1 ppm. In some embodiments, the concentration of 11-oxo-Mogroside IIIE is less than 5%, 3%, 2%, 1%, 0.5%, 0.3%, 0.1%, 800 ppm, 500 ppm, 200 ppm, 100 ppm. 50 ppm, 30 ppm, 20 ppm, 10 ppm, 5 ppm, 1 ppm, or 0.1 ppm. In some embodiments, the concentration of 11-oxo-mogrol is less than 5%, 3%, 2%, 1%, 0.5%, 0.3%, 0.1%, 800 ppm, 500 ppm, 200 ppm, 100 ppm, 50 ppm, 30 ppm, 20 ppm, 10 ppm, 5 ppm, 1 ppm, or 0.1 ppm.

Methods of Producing Compound 1 and Intermediate Mogroside Compounds

In some embodiments, Compound 1 is produced by contact of various starting and/or intermediate compounds with one or more enzymes. The contact can be in vivo (e.g., in a recombinant cell) or in vitro. The starting and intermediate compounds for producing Compound 1 can include, but are not limited to, Mogroside V. Mogroside IIE, Mogroside $III_E$, Siamenoside I, Mogroside VI isomer, Mogroside $II_A$, Mogroside $IV_E$, or Mogroside $IV_A$.

In some embodiments, Compound 1 as disclosed herein is produced in recombinant host cells in vivo as described herein or by modification of these methods. Ways of modifying the methodology include, among others, temperature, solvent, reagents etc., known to those skilled in the art. The methods shown and described herein are illustrative only and are not intended, nor are they to be construed, to limit the scope of the claims in any manner whatsoever. Those skilled in the art will be able to recognize modifications of the disclosed methods and to devise alternate routes based on the disclosures herein; all such modifications and alternate routes are within the scope of the claims.

In some embodiments, Compound 1 disclosed herein is obtained by purification and/or isolation from a recombinant bacterial cell, yeast cell, plant cell, or insect cell. In some embodiments, the recombinant cell is from *Siraitia grosvenorii*. In some such embodiments, an extract obtained from *Siraitia grosvenorii* may be fractionated using a suitable purification technique. In some embodiments, the extract is fractionated using HPLC and the appropriate fraction is collected to obtain the desired compound in isolated and purified form.

In some embodiments, Compound 1 is produced by enzymatic modification of a compound isolated from *Siraitia grosvenorii*. For example, in some embodiments, Compound 1 isolated from *Siraitia grosvenorii* is contacted with one or more enzymes to obtain the desired compounds. The contact can be in vivo (e.g., in a recombinant cell) or in vitro. The starting and intermediate compounds for producing Compound 1 can include, but are not limited to, Mogroside V, Mogroside IIE, Mogroside $III_E$, Siamenoside I, Mogroside VI isomer, Mogroside $II_A$, Mogroside $IV_E$, or Mogroside $IV_A$. One or more of these compounds can be made in vivo. Enzymes suitable for use to generate compounds described herein can include, but are not limited to, a pectinase, a β-galactosidase (e.g., Aromase), a cellulase (e.g., Celluclast), a clyclomatlodextrin glucanotransferase (e.g., Toruzyme), an invertase, a glucostransferase (e.g., UGT76G1), a dextransucrase, a lactase, an arabanse, a xylanase, a hemicellulose, an amylase, or a combination thereof. In some embodiments, the enzyme is a Toruzyme comprises an amino acid sequence set forth in any one of SEQ ID NO: 89-94.

Some embodiments provide a method of making Compound 1,

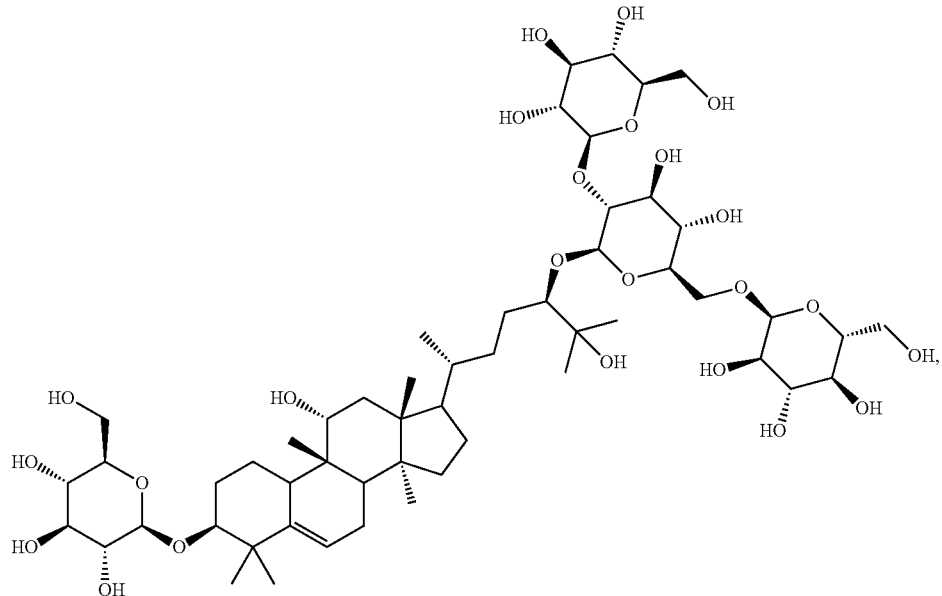 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

the method comprises fractionating an extract of *Siraitia grosvenorii* on an HPLC column and collecting an eluted fraction comprising Compound 1.

Some embodiments provide a method of making Compound 1,

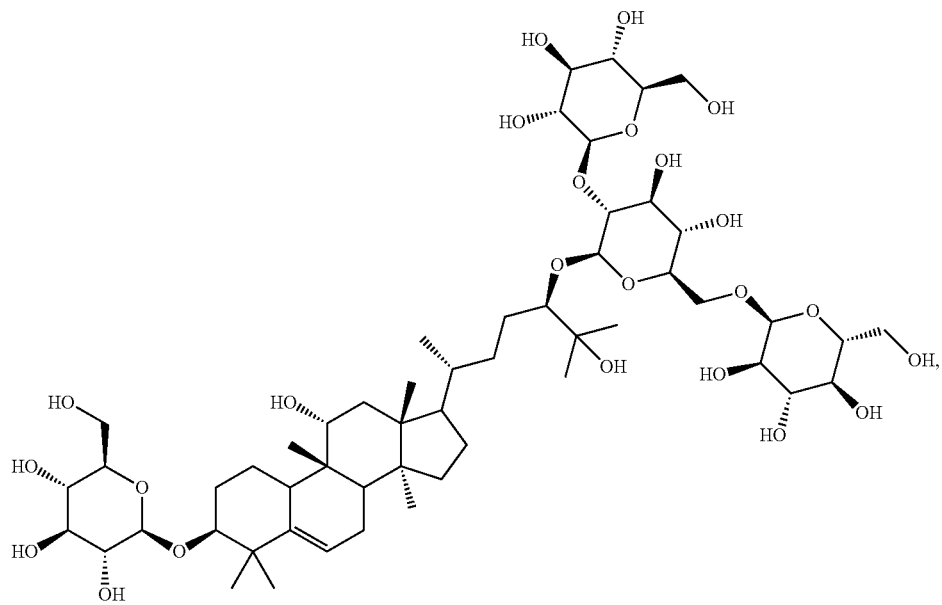

wherein the method comprises treating Mogroside III$_E$ with the glucose transferase enzyme UGT76G1. In some embodiments, UGT76G1 is encoded by a sequence set forth in SEQ ID NO: 440. In some embodiments, UGT76G1 comprises an amino acid sequence set forth in SEQ ID NO: 439.

Various mogroside compounds can be used as intermediate compounds for producing Compound 1. One non-limiting example of such mogroside compounds is Compound 12 having the structure of:

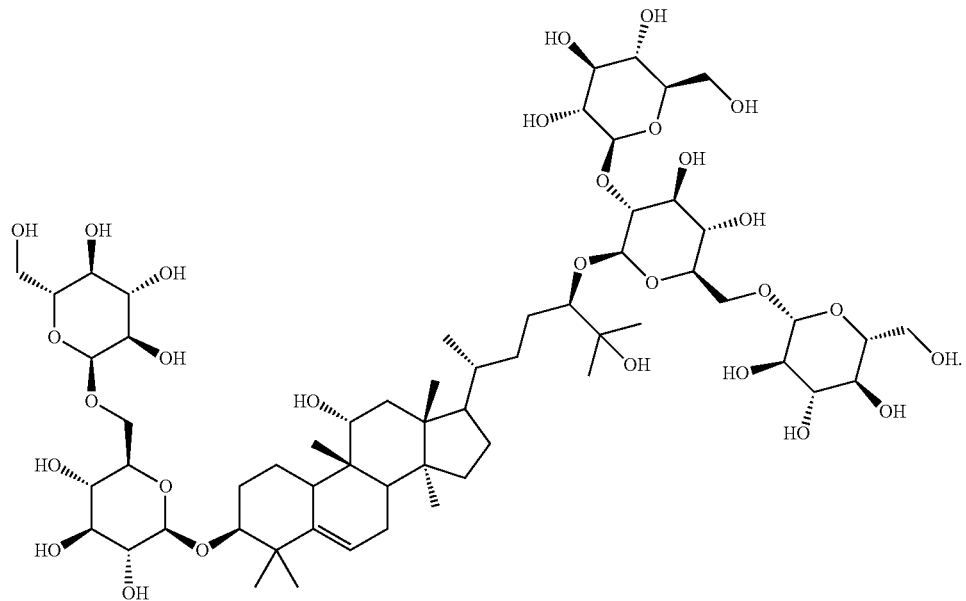

(12)

In some embodiments, a method for producing Compound 12 comprises contacting mogroside VI with a cell (e.g., a recombinant host cell) that expresses one or more invertase.

Various mogroside compounds can be used as intermediate compounds for producing Compound 1. One non-limiting example of such mogroside compounds is Compound 5 having the structure of:

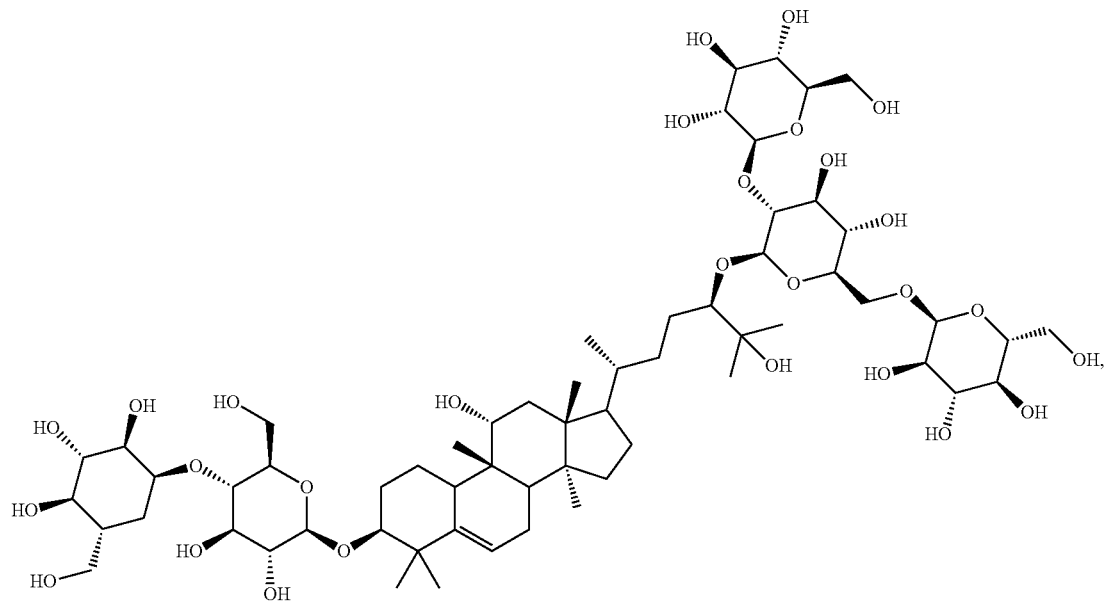

(5)

In some embodiments, a method for producing Compound 5 comprises contacting mogroside IIIE with a cell (e.g., a recombinant host cell) that expresses one or more cyclo-maltodextrin glucanotransferase. In some embodiments, the method is performed in the presence of starch.

Various mogroside compounds can be used as intermediate compounds for producing Compound 1. One non-limiting example of such mogroside compounds is Compound 4 having the structure of:

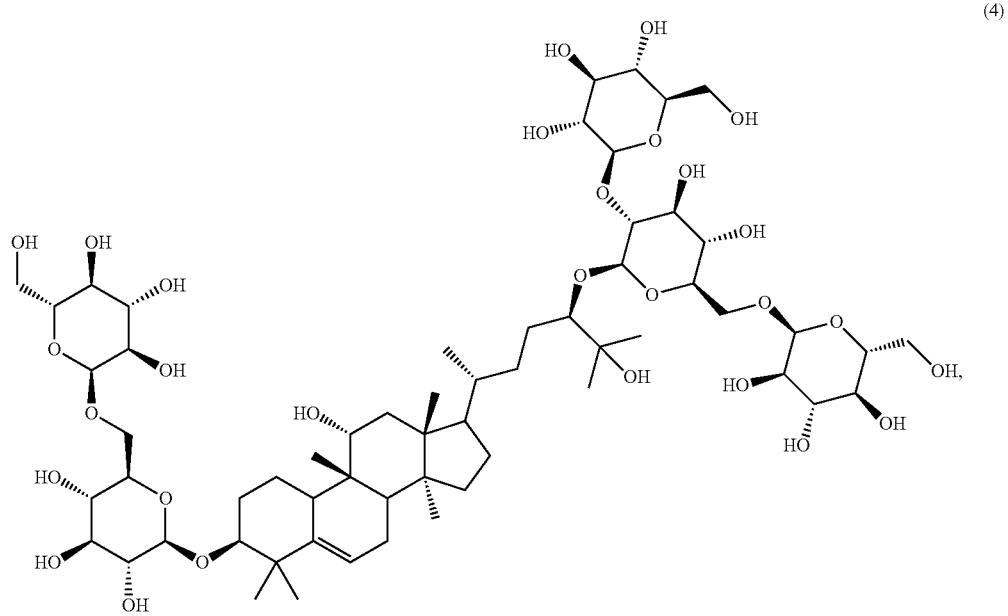 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO[C@H]6O[C@H](CO)[C@@H](O)[C@H](O)[C@H]6O)[C@@H](O)[C@H](O)[C@H]5O)C4(C)C)[C@]3(C)[C@H](O)C[C@]12C]

(4)

In some embodiments, a method for producing Compound 4 comprises contacting mogroside IIIE with a cell (e.g., a recombinant host cell) that expresses one or more cyclomaltodextrin glucanotransferase. In some embodiments, the method is performed in the presence of starch.

Hydrolysis of Hyper-Glycosylated Mogrosides

In some embodiments, one or more hyper-glycosylated mogrosides are hydrolyzed to Mogroside IIIE by contact with one or more hydrolase enzymes. In some embodiments, the hyper-glycosylated mogrosides are selected from a mogroside IV, a mogroside V, a mogroside VI, and combinations thereof. In some embodiments, the hyper-glycosylated mogrosides are selected from Mogroside V, Siamenoside I, Mogroside $IV_E$, Iso-mogroside V, 11-Deoxy-mogroside V, 11-Oxo-mogroside V, Mogroside VI, Mogroside $IV_A$, 11-oxo-Mogroside VI, 11-oxo-Mogroside $IV_E$, and combinations thereof.

It has been surprisingly discovered that Compound 1 displays tolerance to hydrolysis by certain hydrolyzing enzymes, even though such enzymes display capabilities of hydrolyzing hyper-glycosylated mogrosides to Mogroside IIIE. The alpha-linked glycoside present in Compound 1 provides a unique advantage over other mogrosides (e.g., beta-linked glycosides) due to its tolerance to hydrolysis. In some embodiments, during microbial production of Compound 1, the microbial host will hydrolyze unwanted beta-linked mogrosides back to Mogroside IIIE. This will improve the purity of Compound 1 due to the following: 1) Reduction of unwanted Mogroside VI. Mogroside V, and Mogroside IV levels, 2) The hydrolysis will increase the amount of Mogroside IIIE available to be used as a precursor for production of Compound 1.

Figure 38:
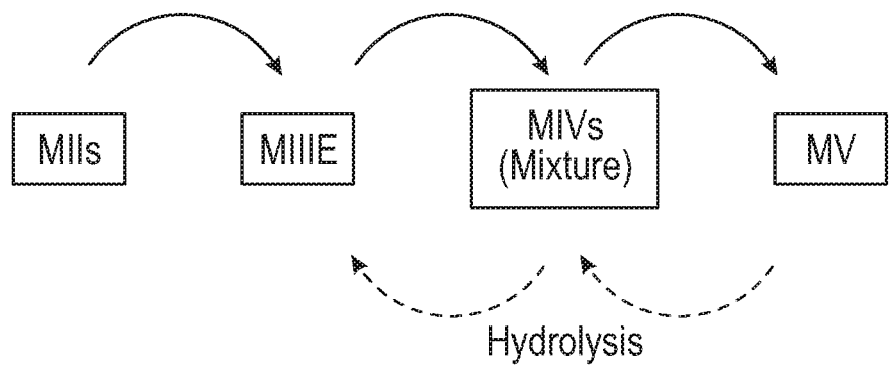
FIG. 38 is a schematic illustration showing the production of hyper-glycosylated mogrosides through glycosolation enzymes, which may then be hydrolyzed back to Mogroside IIIE.

FIG. 38 illustrates the production of hyper-glycosylated mogrosides through glycosolation enzymes, which may then be hydrolyzed back to Mogroside IIIE. The result is a mixture of mogrosides with a lower than desirable yield of hyper-glycosylated mogrosides. The hydrolase enzymes can be removed, but a mixture of mogrosides are still obtained and the lifespan of the producing organism may be reduced.

Figure 39:
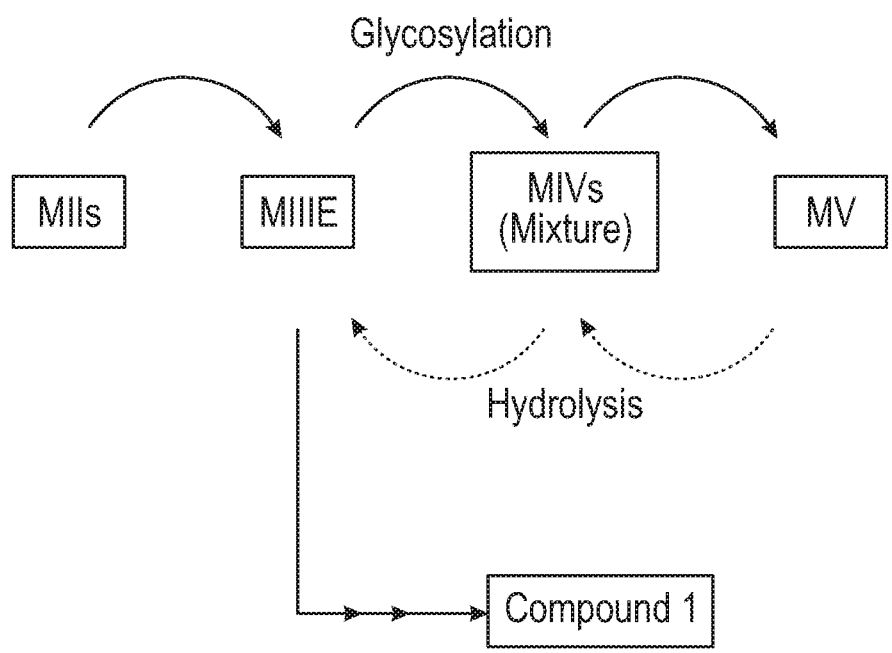
FIG. 39 is a schematic illustration showing how hydrolysis can be used to hydrolyze hyper-glycosylated mogrosides to produce Mogroside IIIE, which can then be converted to Compound 1.

However, because Compound 1 is resistant to hydrolysis, the hydrolysis can be used to drive hyper-glycosylated mogrosides to Mogroside IIIE, which can then be converted to Compound 1 (as shown in FIG. 39).

In some embodiments, the hydrolase is a β-glucan hydrolase. In some embodiments, the hydrolase is EXG1. The EXG1 protein can comprise an amino acid sequence having at least 70%, 80%, 90%, 95%, 98%, 99%, or more sequence identity to SEQ ID NO: 1013 or 1014. In some embodiments, the EXG1 protein comprises, or consists of, an amino acid sequence set forth in SEQ ID NO: 1013 or 1014. In some embodiments, the hydrolase is EXG2. The EXG2 protein can comprise an amino acid sequence having at least 70%, 80%, 90%, 95%, 98%, 99%, or more sequence identity to SEQ ID NO: 1023. In some embodiments, the EXG2 protein comprises, or consists of, an amino acid sequence set forth in SEQ ID NO: 1023. The hydrolase can be, for example, any one of the hydrolases disclosed herein.

Production of Compound 1 from Mogroside IIIE

Compound 1 can be produced from Mogroside IIIE by contact with one or more enzymes capable of converting Mogroside IIIE to Compound 1. In some embodiments, the enzyme capable of catalyzing production of Compound 1 is one or more of UDP glycosyltransferases (also known as UGTs), cyclomaltodextrin glucanotransferases (CGTases), glycotransferases, dextransucrases, cellulases, β-glucosidases, amylases, transglucosidases, pectinases, and dextranases.

In some embodiments, the enzyme capable of catalyzing the production of Compound 1 is a CGTase. In some embodiments, the CGTase comprises an amino acid sequence having at least, 70%, 80%, 85%, 90%, 95%, 98%, 99%, 100%, or a range between any two of these numbers, sequence identity to the sequence of any one of SEQ ID NOs: 1, 3, 78-101, 148, and 154. In some embodiments, the CGTase comprises, or consists of, the amino acid sequence of SEQ ID NOs: 1, 3, 78-101, 148, and 154. In some embodiments, the enzyme capable of catalyzing the production of Compound 1 is a dextransucrase. In some embodiments, the dextransucrase comprises an amino acid sequence having at least, 70%, 80%, 85%, 90%, 95%, 98%, 99%, 100%, or a range between any two of these numbers, sequence identity y to the sequence of any one of SEQ ID NOs: 2, 103, 106-110, 156 and 896. In some embodiments, the dextransucrase comprises, or consists of, an amino acid sequence of any one of SEQ ID NOs: 2, 103, 106-110, 156 and 896. In some embodiments, the dextransucrase is encoded by a nucleic acid sequence having at least, 70%, 80%, 85%, 90%, 95%, 98%, 99%, 100%, or a range between any two of these numbers, sequence identity to any one of SEQ ID NOs: 104, 105, 157, 158, and 895. In some embodiments, the dextransucrase is encoded by a nucleic acid sequence comprising, or consisting of, any one of SEQ ID NOs: 104, 105, 157, 158, and 895. In some embodiments, the enzyme capable of catalyzing the production of Compound 1 is a transglucosidase. In some embodiments, the transglucosidase comprises an amino acid sequence having at least, 70%, 80%, 85%, 90%, 95%, 98%, 99%, 100%, or a range between any two of these numbers, sequence identity to any one of SEQ ID NOs: 163-290 and 723. In some embodiments, the transglucosidase comprises, or consists of, an amino acid sequence of any one of SEQ ID NOs: 163-292 and 723. Parameters for determining the percent sequence identity can be performed with ClustalW software of by Blast searched (ncbi.nih.gov). The use of these programs can determine conservation between protein homologues.

In some embodiments, the enzyme capable of catalyzing the production of Compound 1 is a uridine diphosphate-glucosyl transferase (UGT). The UGT can comprise, for example, an amino acid sequence having at least, 70%, 80%, 85%, 90%, 95%, 98%, 99%, 100%, or a range between any two of these numbers, sequence identity to any one of SEQ ID NOs: 4-9, 15-19, 125, 126, 128, 129, 293-307, 407, 409, 411, 413, 439, 441, 444, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149. In some embodiments, UGT comprises, or consists of, the amino acid sequence of any one of SEQ ID NOs: 4-9, 10-14, 125, 126, 128, 129, 293-304, 306, 407, 409, 411, 413, 439, 441, 444, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149. In some embodiments, the UGT is encoded by a nucleic acid sequence having at least, 70%, 80%, 85%, 90%, 95%, 98%, 99%, 100%, or a range between any two of these numbers, sequence identity to UGT1495 (SEQ ID NO: 10), UGT1817 (SEQ ID NO: 11), UGT5914 (SEQ ID NO: 12), UGT8468 (SEQ ID NO:13), UGT10391 (SEQ ID NO:14), and SEQ ID NOs: 116-124, 127, 130, 408, 410, 412, 414, 440, 442, 443, 445, 1050, 1052, 1054, 1056, 1058, 1060, 1062, 1064, 1066, 1068, 1070, 1075, 1077, 1079, 1081, 1083, 1085, 1087, 1089, 1091, and 1093. In some embodiments, the UGT is encoded by a nucleic acid sequence comprising, consisting of, any one of the nucleic acid sequence of UGT1495 (SEQ ID NO: 10), UGT1817 (SEQ ID NO: 11), UGT5914 (SEQ ID NO: 12), UGT8468 (SEQ ID NO:13), UGT10391 (SEQ ID NO:14), SEQ ID NOs: 116-124, 127, 130, 408, 410, 412, 414, 440, 442, 443, 445, 1050, 1052, 1054, 1056, 1058, 1060, 1062, 1064, 1066, 1068, 1070, 1075, 1077, 1079, 1081, 1083, 1085, 1087, 1089, 1091, and 1093. In some embodiments, the enzyme can be UGT98 or UGT SK98. For example, as described herein, a recombinant host cell capable of producing Compound 1 can comprise a third gene encoding UGT98 and/or UGT SK98. In some embodiments, the UGT98 or UGT SK98 comprises an amino acid sequence having at least, 70%, 80%, 85%, 90%, 95%, 98%, 99%, 100%, or a range between any two of these numbers, sequence identity to SEQ ID NO: 9 or 16. In some embodiments, the UGT comprises an amino acid sequence having at least, 70%, 80%, 85%, 90%, 95%, 98%, 99%, 100%, or a range between any two of these numbers, sequence identity to UGT73C3 (SEQ ID NO: 4), UGT73C6 (SEQ ID NO: 5), UGT85C2 (SEQ ID NO: 6), UGT73C5 (SEQ ID NO: 7), UGT73E1 (SEQ ID NO: 8), UGT98 (SEQ ID NO: 9), UGT1576 (SEQ ID NO: 15), UGT SK98 (SEQ ID NO: 16), UGT430 (SEQ ID NO: 17), UGT1697 (SEQ ID NO: 18), and UGT11789 (SEQ ID NO: 19). In some embodiments, the UGT comprises, or consists of, an amino acid sequence of any one of UGT73C3 (SEQ ID NO: 4), UGT73C6 (SEQ ID NO: 5), 85C2 (SEQ ID NO: 6), UGT73C5 (SEQ ID NO: 7), UGT73E1 (SEQ ID NO: 8), UGT98 (SEQ ID NO: 9), UGT1576 (SEQ ID NO: 15), UGT SK98 (SEQ ID NO:16), UGT430 (SEQ ID NO:17), UGT1697 (SEQ ID NO: 18), and UGT11789 (SEQ ID NO:19). In some embodiments, the UGT is encoded by a nucleic acid sequence at least 70%, 80%, 90%, 95%, 98%, 99% or more sequence identity to UGT1495 (SEQ ID NO: 10), UGT1817 (SEQ ID NO: 11), UGT5914 (SEQ ID NO: 12), UGT8468 (SEQ ID NO:13) or UGT10391 (SEQ ID NO: 14). In some embodiments, the UGT is encoded by a nucleic acid sequence comprising, or consisting of, any one of the sequences of UGT1495 (SEQ ID NO: 10), UGT1817 (SEQ ID NO: 11), UGT5914 (SEQ ID NO: 12), UGT8468 (SEQ ID NO: 13), and UGT10391 (SEQ ID NO: 14). As disclosed herein, the enzyme capable of catalyzing the production of Compound 1 can comprise an amino acid sequence having at least 70%, at least 80%, at least 90%, at least 95%, at least 98%, at least 99%, or more sequence identity to any one of the UGT enzymes disclosed herein. Furthermore, a recombinant host cell capable of producing Compound 1 can comprise an enzyme comprising, or consisting of a sequence having at least 70%, at least 80%, at least 90%, at least 95%, at least 98%, at least 99%, or more sequence identity to any one of the UGT enzymes disclosed herein. In some embodiments, the recombinant host cell comprises an enzyme comprising, or consisting of a sequence of any one of the UGT enzymes disclosed herein.

In some embodiments, the method of producing Compound 1 comprises treating Mogroside III$_E$ with the glucose transferase enzyme UGT76G1, for example the UGT76G1 of SEQ ID NO: 439 and the UGT76G1 encoded by the nucleic acid sequence of SEQ ID NO: 440.

Enzymes for the Production of Mogroside Compounds and Compound 1

As described herein, the enzymes of UDP glycosyltransferases, cyclomaltodextrin glucanotransferases (CGTases), glycotransferases, dextransucrases, cellulases, β-glucosidases, amylases, transglucosidases, pectinases, and dextranases can comprise the amino acid sequences described in the table of sequences herein and can also be encoded by the nucleic acid sequences described in the Table of sequences. Additionally the enzymes can also include functional homologues with at least 70% sequence identity to the amino acid sequences described in the table of sequences. Parameters for determining the percent sequence identity can be performed with ClustalW software of by Blast searched (ncbi.nih.gov). The use of these programs can determine conservation between protein homologues.

In some embodiments, the transglucosidases comprises an amino acid sequence having at least, 70%, 80%, 85%, 90%, 95%, 98%, 99%, 100%, or a range between any two of these numbers, sequence identity to any one of SEQ ID NOs: 163-290 and 723. In some embodiments, the CGTase comprises, or consists of, an amino acid sequence having at least, 70%, 80%, 85%, 90%, 95%, 98%, 99%, 100%, or a range between any two of these numbers, sequence identity to any one of SEQ ID NOs: 1, 3, 78-101, and 154. In some embodiments, the transglucosidases comprise an amino acid sequence or is encoded by a nucleic acid sequence having at least, 70%, 80%, 85%, 90%, 95%, 98%, 99%, 100%, or a range between any two of these numbers, sequence identity to any one of SEQ ID NOs: 163-290 and 723.

The methods herein also include incorporating genes into the recombinant cells for producing intermediates such as pyruvate, acetyl-coa, citrate, and other TCA intermediates (Citric acid cycle). Intermediates can be further used to produce mogroside compounds for producing Compound 1. Methods for increasing squalene content are described in Gruchattka et al. and Rodriguez et al. (PLOS One. 2015 Dec. 23; 10 (12; Microb Cell Fact. 2016 Mar. 3; 15:48; incorporated by reference in their entireties herein).

Expression of enzymes to produce oxidosqualene and diepoxysqualene are further contemplated. The use of enzymes to produce oxidosqualene and diepoxysqualene can be used to boost squalene synthesis by the way of squalene synthase and/or squalene epoxidase. For example, Su et al. describe the gene encoding SgSQS, a 417 amino acid protein from *Siraitia grosvenorii* for squalene synthase (Biotechnol Lett. 2017 Mar. 28; incorporated by reference in its entirety herein). Genetically engineering the recombinant cell for expression of HMG CoA reductase is also useful for squalene synthesis (Appl Environ Microbiol. 1997 September; 63(9):3341-4.; Front Plant Sci. 2011 Jun. 30; 2:25; FEBS J. 2008 April; 275(8):1852-9.; all incorporated by reference in their entireties herein. In some embodiments, the 2, 3-oxidosqualene or diepoxysqualene is produced by an enzyme comprising a sequence having at least, 70%, 80%, 85%, 90%, 95%, 98%, 99%, 100%, or a range between any two of these numbers, sequence identity to SEQ ID NO: 898 or 900. In some embodiments, the 2,3-oxidosqualene or diepoxysqualene is produced by an enzyme encoded by a nucleic acid sequence having at least, 70%, 80%, 85%, 90%, 95%, 98%, 99%, 100%, or a range between any two of these numbers, sequence identity to SEQ ID NO: 897 or 899.

Expression of enzymes to produce cucurbitadienol/epoxycucurbitadienol are also contemplated. Examples of curubitadienol synthases from *C pepo, S grosvenorii, C sativus, C melo, C moschata*, and *C maxim* are contemplated for engineering into the recombinant cells by a vector for expression. Oxidosqualene cyclases for titerpene biosynthesis is also contemplated for expression in the recombinant cell, which would lead to the cyclization of an acyclic substrate into various polycyclic triterpenes which can also be used as intermediates for the production of Compound 1 (Org Biomol Chem. 2015 Jul. 14; 13(26):7331-6; incorporated by reference in its entirety herein).

Expression of enzymes that display epoxide hydrolase activities to make hydroxy-cucurbitadienols are also contemplated. In some embodiments herein, the recombinant cells for the production of Compound 1 further comprises genes that encode enzymes that display epoxide hydrolase activities to make hydroxy-cucurbitadienols are provided. Such enzymes are provided in Itkin et al. which is incorporated by reference in its entirety herein. Ikin et al., also describes enzymes for making key mogrosides, UGS families, glycosyltransferases and hydrolases that can be genetically modified for reverse reactions such as glycosylations.

The expression of enzymes in recombinant cells to that hydroxylate mogroside compounds to produce mogrol are also contemplated. These enzymes can include proteins of the CAZY family, UDP glycosyltransferases, CGTases, Glycotransferases, Dextransucrases, Cellulases, β-glucosidases, Transglucosidases, Pectinases, Dextranases, yeast and fungal hydrolyzing enzymes. Such enzymes can be used for example for hydrolyzing Mogroside V to Mogroside IIIE, in which Mogroside IIIE can be further processed to produce Compound 1, for example in vivo. In some embodiments, fungal lactases comprise an amino acid sequence having at least, 70%, 80%, 85%, 90%, 95%, 98%, 99%, 100%, or a range between any two of these numbers, sequence identity to anyone of SEQ ID NO: 678-722.

In some embodiments, a mogrol precursor such as squalene or oxidosqualine, mogrol or mogroside is produced. The mogrol precursor can be used as a precursor in the production of Compound 1. Squalene can be produced from farnesyl pyrophosphate using a squalene synthase, and oxidosqualene can be produced from squalene using a squalene epoxidase. The squalene synthase can be, for example, squalene synthase from *Gynostemma pentaphyllum* (protein accession number C4P9M2), a cucurbitaceae family plant. The squalene synthase can also comprise a squalene synthase from *Arabidopsis thaliana* (protein accession number C4P9M3), *Brassica napus, Citrus macrophylla, Euphorbia tirucalli* (protein accession number B9WZW7), *Glycine max, Glycyrrhiza glabra* (protein accession number Q42760, Q42761), *Glycyrrhiza uralensis* (protein accession number D6QX40, D6QX41, D6QX42, D6QX43, D6QX44, D6QX45, D6QX47, D6QX39, D6QX55, D6QX38, D6QX53, D6QX37, D6QX35, B5AID5, B5AID4, B5AID3, C7EDD0, C6KE07, C6KE08, C7EDC9), *Lotus japonicas* (protein accession number Q84LE3), *Medicago truncatula* (protein accession number Q8GSL6), *Pisum sativum, Ricinus communis* (protein accession number B9RHC3). Various squalene synthases have described in WO 2016/050890, the content of which is incorporated herein by reference in its entirety.

Recombinant Host Cells

Any one of the enzymes disclosed herein can be produced in vitro, ex vivo, or in vivo. For example, a nucleic acid sequence encoding the enzyme (including but not limited to any one of UGTs, CGTases, glycotransferases, dextransucrases, celluases, beta-glucosidases, amylases, transglucosidases, pectinases, dextranases, cytochrome P450, epoxide hydrolases, cucurbitadienol synthases, squalene epoxidases, squalene synthases, hydrolases, and oxidosqualene cyclases) can introduced to a host recombinant cell, for example in the form of an expression vector containing the coding nucleic acid sequence, in vivo. The expression vectors can be introduced into the host cell by, for example, standard transformation techniques (e.g., heat transformation) or by transfection. The expression systems can produce the enzymes for mogroside and Compound 1 production, in order to produce Compound 1 in the cell in vivo. Useful expression systems include, but are not limited to, bacterial, yeast and insect cell systems. For example, insect cell systems can be infected with a recombinant virus expression system for expression of the enzymes of interest. In some embodiments, the genes are codon optimized for expression in a particular cell. In some embodiments, the genes are operably linked to a promoter to drive transcription and translation of the enzyme protein. As described herein, codon optimization can be obtained, and the optimized sequence can then be engineered into a vector for transforming a recombinant host cell.

Expression vectors can further comprise transcription or translation regulatory sequences, coding sequences for transcription or translation factors, or various promoters (e.g., GPD1 promoters) and/or enhancers, to promote transcription of a gene of interest in yeast cells.

The recombinant cells as described herein are, in some embodiments, genetically modified to produce Compound 1 in vivo. Additionally, a cell can be fed a mogrol precursor or mogroside precursor during cell growth or after cell growth to boost rate of the production of a particular intermediate for the pathway for producing Compound 1 in vivo. The cell can be in suspension or immobilized. The cell can be in fermentation broth or in a reaction buffer. In some embodiments, a permeabilizing agent is used for transfer of a mogrol precursor or mogroside precursor into a cell. In some embodiments, a mogrol precursor or mogroside precursor can be provided in a purified form or as part of a composition or an extract.

The recombinant host cell can be, for example a plant, bivalve, fish, fungus, bacteria or mammalian cell. For example, the plant can be selected from *Siraitia, Momordica, Gynostemma, Cucurbita, Cucumis, Arabidopsis, Artemisia, Stevia, Panax, Withania, Euphorbia, Medicago, Chlorophytum, Eleutherococcus, Aralia, Morus, Medicago, Betula, Astragalus, Jatropha, Camellia, Hypholoma, Aspergillus, Solanum, Huperzia, Pseudostellaria, Corchorus, Hedera, Marchantia*, and *Morus*. The fungus can be selected from *Trichophyton, Sanghuangporus, Taiwanofungus, Moniliophthora, Marssonina, Diplodia, Lentinula, Xanthophyllomyces, Pochonia, Colletotrichum, Diaporthe, Histoplasma, Coccidioides, Histoplasma, Sanghuangporus, Aurcobasidium, Pochonia, Penicillium, Sporothrix, Metarhizium, Aspergillus, Yarrowia*, and *Lipomyces*. In some embodiments, the fungus is *Aspergillus nidulans, Yarrowia lipolytica*, or *Rhodosporin toruloides*. In some embodiments, the recombinant host cell is a yeast cell. In some embodiments, the yeast is selected from *Candida, Sacccharaomyces, Saccharomycotina, Taphrinomycotina, Schizosaccharomyces, Komagataella, Basidiomycota, Agaricomycotina, Tremellomycetes, Pucciniomycotina, Aurcobasidium, Coniochacta, Rhodosporidium, Yarrowia*, and *Microboryomycetes*. In some embodiments, the bacteria is selected from *Frankia, Actinobacteria, Streptomyces*, and *Enterococcus*. In some embodiments, the bacteria is *Enterococcus faecalis*.

In some embodiments, the recombinant genes are codon optimized for expression in a bacterial, mammalian, plant, fungal or insect cell. In some embodiments, one or more of genes comprises a functional mutation to increased activity of the encoded enzyme. In some embodiments, cultivating the recombinant host cell comprises monitoring the cultivating for pH, dissolved oxygen level, nitrogen level, or a combination thereof of the cultivating conditions.

Producing Mogrol from Squalene

Some embodiments of the method of producing Compound 1 comprises producing an intermediate for use in the production of Compound 1. The compound having the structure of:

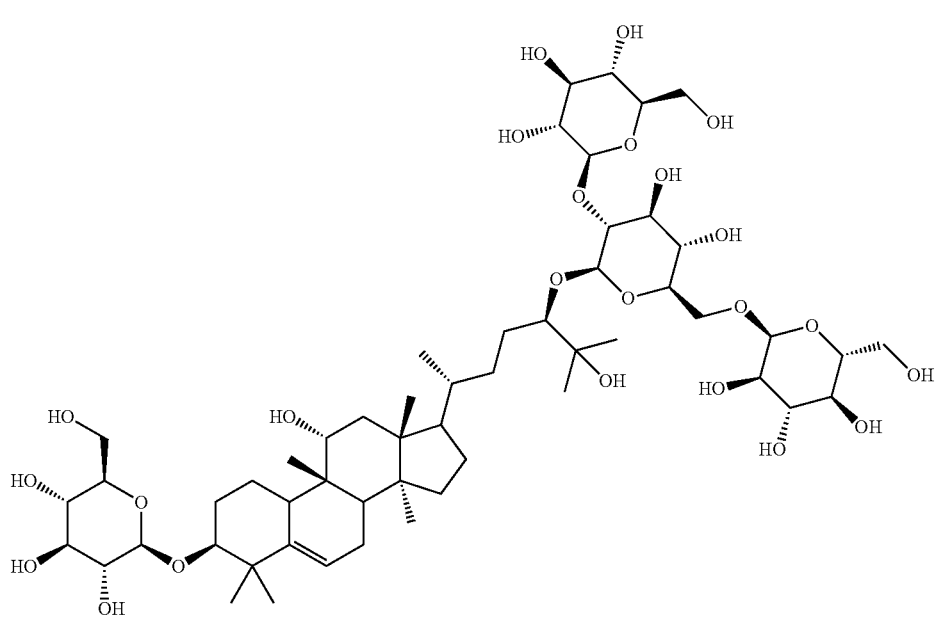

(1)

is produced in vivo in a recombinant host. In some embodiments, the compound is in the recombinant host cell, is secreted into the medium in which the recombinant cell is growing, or both. In some embodiments, the recombinant cell further produces intermediates such as mogroside compounds in vivo. The recombinant cell can be grown in a culture medium, under conditions in which the genes disclosed herein are expressed. Some embodiments of methods of growing the cell are described herein.

In some embodiments, the intermediate is, or comprises, at least one of squalene, oxidosqualene, curubitadienol, mogrol and mogrosides. In some embodiments, the mogroside is Mogroside IIE. As described herein, mogrosides are a family of glycosides that can be naturally isolated from a plant or a fruit, for example. As contemplated herein, the mogrosides can be produced by a recombinant host cell.

In some alternatives of the methods described herein, the recombinant host cell comprises a polynucleotide or a sequence comprising one or more of the following:
- a gene encoding squalene epoxidase;
- a gene encoding cucurbitadienol synthase;
- a gene encoding cytochrome P450;
- a gene encoding cytochrome P450 reductase; and
- a gene encoding epoxide hydrolase.

In some embodiments, the squalene epoxidase comprises a sequence having at least, 70%, 80%, 85%, 90%, 95%, 98%, 99%, 100%, or a range between any two of these numbers, sequence identity to SEQ ID NO: 54. In some embodiments, the squalene epoxidase comprises a sequence from *Arabidopsis thaliana* (the protein accession numbers: Q9SM02, O65403, O65402, O65404, O81000, or Q9T064), *Brassica napus* (protein accession number 10 065727, 065726), *Euphorbia tirucalli* (protein accession number A7VJN1), *Medicago truncatula* (protein accession number Q8GSM8, Q8GSM9), *Pisum sativum*, and *Ricinus communis* (protein accession number B9R6VO, B9S7W5, B9S6Y2, B9TOY3, B9S7TO, B9SX91) and functional homologues of any of the aforementioned sharing at least 70%, such as at least 80%, for example at least 90%, such as at least 95%, for example at least 98% sequence identity therewith. In some embodiments, the squalene epoxidase comprises, or consists of an amino acid sequence having at least, 70%, 80%, 85%, 90%, 95%, 98%, 99%, 100%, or a range between any two of these numbers, sequence identity to SEQ ID NOs: 50-56, 60, 61, 334 or 335.

In some embodiments, the cell comprises genes encoding ERG7 (lanosterol synthase). In some embodiments, lanosterol synthase comprises a sequence having at least, 70%, 80%, 85%, 90%, 95%, 98%, 99%, 100%, or a range between any two of these numbers, sequence identity to SEQ ID NO: 111. In some embodiments, the P450 polypeptide is encoded in genes comprising a sequence having at least, 70%, 80%, 85%, 90%, 95%, 98%, 99%, 100%, or a range between any two of these numbers, sequence identity to any one of Claims: 31-48. In some embodiments, the sequences can be separated by ribosome skip sequences to produce separated proteins.

In some embodiments, the recombinant host cell comprises a gene encoding a polypeptide having cucurbitadienol synthase activity. In some embodiments, the polypeptide having cucurbitadienol synthase activity comprises an amino acid sequence as set forth in any one of SEQ ID NOs: 70-73, 75-77, 319, 321, 323, 325, 327-333, 420, 422, 424, 426, 446, 902, 904, and 906. In some embodiments, the polypeptide having cucurbitadienol synthase activity comprises a sequence having at least, 70%, 80%, 85%, 90%, 95%, 98%, 99%, 100%, or a range between any two of these numbers, sequence identity to the sequence of any one of SEQ ID NO: 70-73, 75-77, 319, 321, 323, 325, 327-333, 420, 422, 424, 426, 446, 902, 904 and 906. In some embodiments, the polypeptide having cucurbitadienol synthase activity comprises a C-terminal portion comprising the sequence set forth in SEQ ID NO: 73. In some embodiments, the gene encoding the polypeptide having cucurbitadienol synthase activity is codon optimized. In some embodiments, the codon optimized gene comprises the nucleic acid sequence set forth in SEQ ID NO: 74.

In some embodiments, the polypeptide having cucurbitadienol synthase activity is a fusion polypeptide comprising a fusion domain fused to a cucurbitadienol synthase. The fusion domain can be fused to, for example, N-terminus or C-terminus of a cucurbitadienol synthase. The fusion domain can be located, for example, at the N-terminal region or the C-terminal region of the fusion polypeptide. The length of the fusion domain can vary. For example, the fusion domain can be, or be about, 3, 4, 5, 6, 7, 8, 9, 10, 12, 15, 20, 25, 30, 40, 50, 100, 150, 200, 300, 400, 500, 600, 700, 800, 900, 1000, 1500, 2000, or a range between any two of these numbers amino acids long. In some embodiments, the fusion domain is 3 to 1000 amino acids long. In some embodiments, the fusion domain is 5 to 50 amino acids long. In some embodiments, the fusion domain comprises a substantial portion or the entire sequence of a functional protein. In some embodiments, the fusion domain comprises a portion or the entire sequence of a yeast protein. For example, the fusion polypeptide having cucurbitadienol synthase activity can comprise an amino acid sequence having, or having at least, 70%, 80%, 85%, 90%, 95%, 98%, 99%, or 100% sequence identity to any one of SEQ ID NOs: 851, 854, 856, 1024, 859, 862, 865, 867, 915, 920, 924, 928, 932, 936, 940, 944, 948, 952, 956, 959, 964, 967, 971, 975, 979, 983, 987, 991, 995, 999, 1003, 1007, and 1011. In some embodiments, the fusion polypeptide comprises, or consists of, an amino acid sequence set forth in any one of SEQ ID NOs: 851, 854, 856, 1024, 859, 862, 865, 867, 915, 920, 924, 928, 932, 936, 940, 944, 948, 952, 956, 959, 964, 967, 971, 975, 979, 983, 987, 991, 995, 999, 1003, 1007, and 1011. In some embodiments, the fusion domain of the fusion polypeptide comprises an amino acid sequence having, or having at least, 70%, 80%, 85%, 90%, 95%, 98%, 99%, or 100% sequence identity to any one of SEQ ID NOs: 866, 870, 917, 921, 925, 929, 933, 937, 941, 945, 949, 953, 957, 961, 968, 972, 976, 980, 984, 988, 992, 996, 1000, 1004, 1008, and 1012. In some embodiments, the fusion domain of the fusion polypeptide comprises, or consists of, an amino acid sequence set forth in any one of SEQ ID NOs: 866, 870, 917, 921, 925, 929, 933, 937, 941, 945, 949, 953, 957, 961, 968, 972, 976, 980, 984, 988, 992, 996, 1000, 1004, 1008, and 1012. In some embodiments, the cucurbitadienol synthase fused with the fusion domain comprises an amino acid sequence having, or having at least, 70%, 80%, 85%, 90%, 95%, 98%, 99%, or 100% sequence identity to any one of SEQ ID NOs: 70-73, 75-77, 319, 321, 323, 325, 327, 329-333, 420, 422, 424, 426, 446, 902, 904, and 906. In some embodiments, the cucurbitadienol synthase fused with the fusion domain comprises, or consists of, an amino acid sequence set forth in any one of SEQ ID NOs: 70-73, 75-77, 319, 321, 323, 325, 327, 329-333, 420, 422, 424, 426, 446, 902, 904, and 906. In some embodiments, the cucurbitadienol synthase fused with the fusion domain is encoded by a gene comprising a nucleic acid sequence having, or having at least, 70%, 80%, 85%, 90%, 95%, 98%, 99%, or 100% sequence identity to any one of SEQ ID NOs: 74, 320, 322, 324, 326, 328, 418, 421, 423, 425, 427, 897, 899, 901, 903, and 905. In some embodiments, the cucurbitadienol synthase fused with the fusion domain is encoded by a gene comprising, or consists of, a nucleic acid sequence set forth in any one of SEQ ID NOs: 74, 320, 322, 324, 326, 328, 418, 421, 423, 425, 427, 897, 899, 901, 903, and 905. Disclosed herein include a recombinant nucleic acid molecule comprising a nucleic acid sequence encoding a fusion polypeptide having cucurbitadienol synthase activity. Also disclosed include a recombinant cell comprising a fusion polypeptide having cucurbitadienol synthase activity or a recombinant nucleic acid molecule encoding the fusion polypeptide.

The fusion polypeptides having cucurbitadienol synthase activity disclosed herein can be used to catalyze enzymatic reactions as cucurbitadienol synthases. For example, a substrate for cucurbitadienol synthase can be contacted with one or more of these fusion polypeptide to produce reaction products. Non-limiting examples of the reaction product include curcurbitadienol, 24,25-epoxy curcurbitadienol, and any combination thereof. Non-limiting examples of the substrate for cucurbitadienol synthase include 2,3-oxidosqualene, dioxidosqualene, diepoxysqualene, and any combination thereof. In some embodiments, the substrate can be contacted with a recombinant host cell which comprises a nucleic acid sequence encoding one or more fusion polypeptides having cucurbitadienol synthase activity. The substrate can be provided to the recombinant host cells, present in the recombinant host cell, produced by the recombinant host cell, or any combination thereof.

In some embodiments, the cytochrome P450 is a CYP5491. In some embodiments, the cytochrome P450 comprises an amino acid sequence having, or having at least, 50%, 60%, 70%, 80%, 90%, 95%, 98%, 99%, 100%, or a range between any two of these numbers, sequence identity to the sequence set forth in any one of SEQ ID NOs: 44, 74, 1025, 1027, 1029, 1031, 1033, 1035, 1037, 1039, 1041, 1043, 1045, 1047, and 1049. In some embodiments, the P450 reductase polypeptide comprises an amino acid sequence having, or having at least, 50%, 60%, 70%, 80%, 90%, 95%, 98%, 99%, 100%, or a range between any two of these numbers, sequence identity to SEQ ID NO: 46. In some embodiments, the P450 polypeptide is encoded by a gene comprising a sequence having, or having at least, 50%, 60%, 70%, 80%, 90%, 95%, 98%, 99%, 100% or a range between any two of these numbers, sequence identity to any one of SEQ ID NOs: 31-48, 316, 431, 871, 873, 875, 877, 879, 881, 883, 885, 887, 891, 1024, 1026, 1028, 1030, 1032, 1034, 1036, 1038, 1040, 1042, 1044, 1046, and 1048.

In some embodiments, the epoxide hydrolase comprises an sequence having, or having at least, 70%, 80%, 90%, 95%, 98%, 99%, 100%, or a range between any two of these numbers, sequence identity to SEQ ID NO: 38, 40 or 1073. In some embodiments, the epoxide hydrolase comprises, or consists of, the sequence set forth in SEQ ID NO: 38, 40 or 1073. In some embodiments, the epoxide hydrolase is encoded by a nucleic acid sequence having at least 70%, 80%, 90%, 95%, 98%, 99%, 100%, or a range between any two of these numbers, sequence identity to SEQ ID NO: 1072.

Some Methods of Producing Squalene for Mogrol Production

Squalene is a natural 30 carbon organic molecule that can be produced in plants and animals and is a biochemical precursor to the family of steroids. Additionally, squalene can be used as precursor in mogrol syntheses in vivo in a host recombinant cell. Oxidation (via squalene monooxygenase) of one of the terminal double bonds of squalene yields 2,3-squalene oxide, which undergoes enzyme-catalyzed cyclization to afford lanosterol, which is then elaborated into cholesterol and other steroids. As described in Gruchattka et al. ("In Vivo Validation of In Silico Predicted Metabolic Engineering Strategies in Yeast: Disruption of α-Ketoglutarate Dehydrogenase and Expression of ATP-Citrate Lyase for Terpenoid Production." PLOS ONE Dec. 23, 2015; incorporated by reference in its entirety herein), synthesis of squalene can occur initially from precursors of the glycolysis cycle to produce squalene. Squalene in turn can be upregulated by the overexpression of ATP-citrate lyase to increase the production of squalene. Some embodiments disclosed herein include enzymes for producing squalene and/or boosting the production of squalene in recombinant host cells, for example recombinant yeast cells. ATP citrate lyase can also mediate acetyl CoA synthesis which can be used for squalene and mevalonate production, which was seen in yeast, *S. cerevisiae* (Rodrigues et al. "ATP citrate lyase mediated cytosolic acetyl-CoA biosynthesis increases mevalonate production in *Saccharomyces cerevisiae*" Microb Cell Fact. 2016; 15: 48.; incorporated by reference in its entirety). On example of the gene encoding an enzyme for mediating the acetyl CoA synthesis is set forth in SEQ ID NO: 130. In some embodiments herein, the recombinant cell comprises sequences for mediating acetyl CoA synthesis.

Some embodiments disclosed herein provide methods for producing Compound 1 having the structure of:

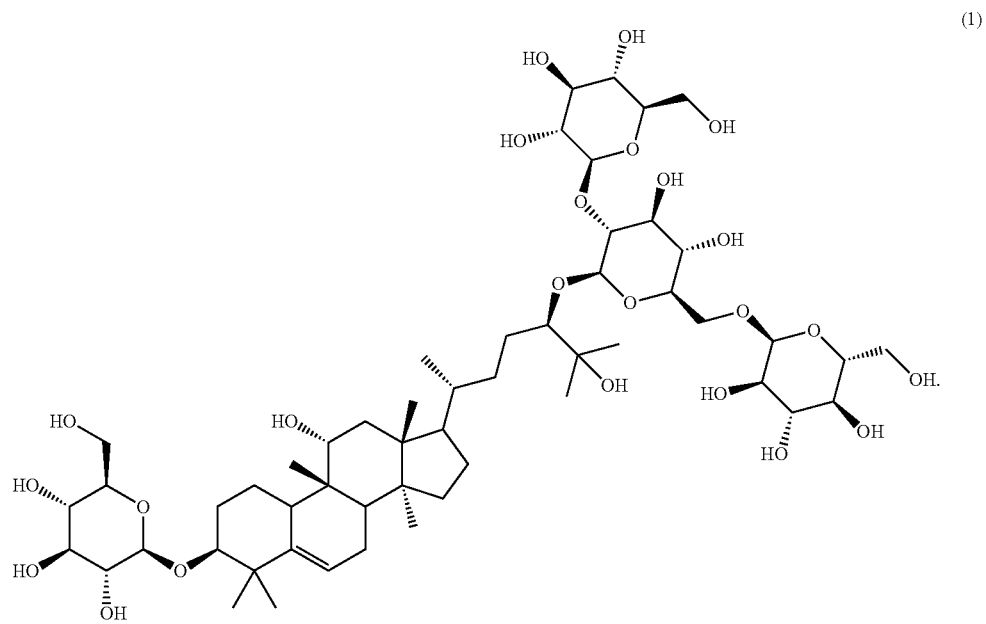 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

In some embodiments, the methods further comprises producing intermediates in the pathway for the production of compound 1 in vivo. In some embodiments, the recombinant host cell that produces Compound 1 comprises at least one enzyme capable for converting dioxidosqualene to produce 24,25 epoxy cucurbitadienol, converting oxidosqualene to cucurbitadienol, catalyzing the hydroxylation of 24,25, epoxy cucurbitadienol to 11-hydroxy-24,25 epoxy cucurbitadienol, enzyme for catalyzing the hydroxylation of cucurbitadienol to 11-hydroxy-cucurbitadienol, enzyme for the epoxidation of cucurbitadienol to 24,25 epoxy cucurbitadienol, enzymes capable of catalyzing epoxidation of 11-hydroxy-cucurbitadienol to produce 11-hydroxy-24,25 epoxy cucurbitadienol, enzymes for the conversion of 11-hydroxy-cucurbtadienol to 11-hydroxy-24,25 epoxy cucurbitadienol, enzymes for catalyzing the conversion of 11-hydroxy-24,25 epoxy cucurbitadienol to produce mogrol and/or enzymes for catalyzing the glycosylation of a mogroside precursor to produce a mogroside compound. In some embodiments, the enzyme for glycosylation is encoded by a sequence set forth in any one of SEQ ID NOs: 121, 122, 123, and 124.

In some embodiments, the enzyme for catalyzing the hydroxylation of 24,25 epoxy cucurbitadienol to form 11-hydroxy-24,25 epoxy cucurbitadinol is CYP5491. In some embodiments, the CYP5491 comprises a sequence set forth in SEQ ID NO: 49. In some embodiments, the squalene epoxidase comprises a sequence having at least, 70%, 80%, 85%, 90%, 95%, 98%, 99%, 100%, or a range between any two of these numbers, sequence identity to the sequence of SEQ ID NO: 54.

In some embodiments, the enzyme capable of epoxidation of 11-hydroxycucurbitadientol comprises an amino acid sequence set forth in SEQ ID NO: 74.

In some alternatives, the recombinant cell comprises genes for expression of enzymes capable of converting dioxidosqualent to 24,25 epoxy cucurbitadienol, converting oxidosqualene to cucurbitadienol, hydroxylation of 24,25 epoxy cucurbitadienol to 11-hydroxy-24,25 epoxy cucurbitadienol, hydroxylation of cucurbitadienol to produce 11-hydroxy-cucurbitadienol, epoxidation of cucurbitadienol to produce 24,25 epoxy cucurbitadienol, and/or epoxidation of 11-hydroxycucurbitadienol to produce 11-hydroxy-24,25 epoxy cucurbitadienol. In these embodiments herein, the intermediates and mogrosides are produced in vivo.

In some embodiments, a method of producing Compound 1 further comprises producing one or more of mogroside compounds and intermediates, such as oxidosqualene, dixidosqualene, cucurbitdienol, 24,25 epoxy cucurbitadienol, 11-hydrosy-cucurbitadienol, 11-hydroxy 24,25 epoxy cucurbitadienol, mogrol, and mogroside compounds.

Methods for the Production of Mogroside Compounds

Described herein include methods of producing a mogroside compound, for example, one of the mogroside compounds described in WO2014086842 (incorporated by reference in its entirety herein). The mogroside compound can be used as an intermediate by a cell to further produce Compound 1 disclosed herein.

Recombinant hosts such as microorganisms, plant cells, or plants can be used to express polypeptides useful for the biosynthesis of mogrol (the triterpene core) and various mogrol glycosides (mogrosides).

In some embodiments, the production method can comprise one or more of the following steps in any orders:

(1) enhancing levels of oxido-squalene
(2) enhancing levels of dioxido-squalene
(3) Oxido-squalene→cucurbitadienol
(4) Dioxido-squalene→24,25 epoxy cucurbitadienol
(5) Cucurbitadienol→11-hydroxy-cucurbitadienol
(6) 24,25 epoxy cucurbitadienol→11-hydroxy-24,25 epoxy cucurbitadienol
(7) 11-hydroxy-cucurbitadienol→mogrol
(8) 11-hydroxy-24,25 epoxy cucurbitadienol→mogrol
(9) mogrol→various mogroside compounds.

In the embodiments herein, the oxido-squalene, dioxido-squalene, cucurbitadienol, 24,25 epoxy cucurbitadienol or mogrol may be also produced by the recombinant cell. The method can include growing the recombinant microorganism in a culture medium under conditions in which one or more of the enzymes catalyzing step(s) of the methods of the invention, e.g. synthases, hydrolases, CYP450s and/or UGTs are expressed. The recombinant microorganism may be grown in a fed batch or continuous process. Typically, the recombinant microorganism is grown in a fermenter at a defined temperature(s) for a desired period of time in order to increase the yield of Compound 1.

In some embodiments, mogroside compounds can be produced using whole cells that are fed raw materials that contain precursor molecules to increase the yield of Compound 1. The raw materials may be fed during cell growth or after cell growth. The whole cells may be in suspension or immobilized. The whole cells may be in fermentation broth or in a reaction buffer.

In some embodiments, the recombinant host cell can comprise heterologous nucleic acid(s) encoding an enzyme or mixture of enzymes capable of catalyzing Oxido-squalene to cucurbitadienol, Cucurbitadienol to 11-hydroxycucurbitadienol, 11-hydroxy-cucurbitadienol to mogrol, and/or mogrol to mogroside. In some embodiments, the cell can further comprise Heterologous nucleic acid(s) encoding an enzyme or mixture of enzymes capable of catalyzing Dioxidosqualene to 24,25 epoxy cucurbitadienol, 24,25 epoxy cucurbitadienol to hydroxy-24,25 epoxy cucurbitadienol, 11-hydroxy-24,25 epoxy cucurbitadienol to mogrol, and/or mogrol to mogroside The host cell can comprise a recombinant gene encoding a cucurbitadienol synthase and/or a recombinant gene encoding a cytochrome P450 polypeptide.

In some embodiments, the cell comprises a protein having at least, 70%, 80%, 85%, 90%, 95%, 98%, 99%, 100%, or a range between any two of these numbers, sequence identity to any one of SEQ ID NOs: 70-73, 75-77, 319, 321, 323, 325, 327-333, 420, 422, 424, 426, 446, 902, 904, and 906 (curcurbitadienol synthase).

In some embodiments, the conversion of Oxido-squalene to cucurbitadienol is catalyzed by cucurbitadienol synthase of any one of SEQ ID NOs: 70-73, 75-77, 319, 321, 323, 325, 327-333, 420, 422, 424, 426, 446, 902, 904, and 906, or a functional homologue thereof sharing at least 70%, such as at least 80%, for example at least 90%, such as at least 95%, for example at least 98% sequence identity therewith. In some embodiments, the cucurbitadienol synthase polypeptide comprises a C-terminal portion comprising the sequence set forth in SEQ ID NO: 73. In some embodiments, the gene encoding the cucurbitadienol synthase polypeptide is codon optimized. In some embodiments, the codon optimized gene comprises the nucleic acid sequence set forth in SEQ ID NO: 74.

In some embodiments, the conversion of Cucurbitadienol to 11-hydroxy-cucurbitadienol is catalyzed CYP5491 of SEQ ID NO: 49 or a functional homologue thereof sharing at least 70%, such as at least 80%, for example at least 90%, such as at least 95%, for example at least 98% sequence identity therewith.

In some embodiments, the conversion of 11-hydroxycucurbitadienol to mogrol comprises a polypeptide selected from the group consisting of Epoxide hydrolase 1 of SEQ ID NO: 29, Epoxide hydrolase 2 of SEQ ID NO: 30 and functional homologues of the aforementioned sharing at least 70%, such as at least 80%, for example at least 90%, such as at least 95%, for example at least 98% sequence identity therewith. In some embodiments, the genes encoding epoxide hydrolase 1 and epoxide hydrolase 2 are codon optimized for expression. In some embodiments, the codon optimized genes for epoxide hydrolase comprise a nucleic acid sequence set forth in SEQ ID NO: 114 or 115.

In some embodiments, the epoxide hydrolase comprises an amino acid sequence as set forth in any one of SEQ ID NOs: 21-28 (Itkin et al, incorporated by reference in its entirety herein).

In some embodiments, the conversion of mogrol to mogroside is catalyzed in the host recombinant cell by one or more UGTs selected from the group consisting of UGT1576 of SEQ ID NO: 15, UGT98 of SEQ ID NO: 9, UGT SK98 of SEQ ID NO: 68 and functional homologues of the aforementioned sharing at least 70%, such as at least 80%, for example at least 90%, such as at least 95%, for example at least 98% sequence identity therewith.

In some embodiments, the host recombinant cell comprises a recombinant gene encoding a cytochrome P450 polypeptide is encoded by any one of the sequences in SEQ ID NOs: 31-48, 316, 431, 871, 873, 875, 877, 879, 881, 883, 885, 887, 891, NOs: 1050, 1052, 1054, 1056, 1058, 1060, 1062, 1064, 1066, 1068, 1070, 1075, 1077, 1079, 1081, 1083, 1085, 1087, 1089, 1091, and 1093.

In some embodiments, the host recombinant cell comprises a recombinant gene encoding squalene epoxidase polypeptide comprising the sequence in SEQ ID NO: 50.

In some embodiments, the host recombinant cell comprises a recombinant gene encoding cucurbitadienol synthase polypeptide of any one of SEQ ID NOs: 70-73, 75-77, 319, 321, 323, 325, 327-333, 420, 422, 424, 426, 446, 902, 904, and 906. In some embodiments, the cucurbitadienol synthase polypeptide comprises a C-terminal portion comprising the sequence set forth in SEQ ID NO: 73. In some embodiments, the gene encoding the cucurbitadienol synthase polypeptide is codon optimized. In some embodiments, the codon optimized gene comprises the nucleic acid sequence set forth in SEQ ID NO: 74.

Production of Mogroside Compounds from Mogrol

In some embodiments, the method of producing Compound 1 comprises contacting mogroside IIIE with a first enzyme capable of catalyzing production of Compound 1 from mogroside IIIE. In some embodiments, the method is performed in vivo, wherein a recombinant cell comprises a gene encoding the first enzyme capable of catalyzing production of Compound 1 from mogroside IIIE. In some embodiments, the cell further comprises a gene encoding an enzyme capable of catalyzing production of mogroside IE1 from mogrol. In some embodiments, the enzyme comprises a sequence set forth in any one of SEQ ID NOs: 4-8.

In some embodiments, the cell further comprises enzymes to convert mogroside IIE to mogroside IV, mogroside V. 11-oxo-mogroside V, and siamenoside I. In some embodiments, the enzymes for converting mogroside IIE to mogroside IV, mogroside V, 11-oxo-mogroside V, and siamenoside I are encoded by genes that comprise the nucleic acid sequences set forth in SEQ ID NOs: 9-14 and 116-120. In some embodiments, the method of producing Compound 1 comprises treating Mogroside IIIE with the glucose transferase enzyme UGT76G1.

In some embodiments, the method comprises fractionating lysate from a recombinant cell on an HPLC column and collecting an eluted fraction comprising Compound 1.

In some embodiments, the method comprises contacting mogroside IIIE with a first enzyme capable of catalyzing production of Compound 1 from mogroside IIIE. In some embodiments, contacting mogroside IIIE with the first enzyme comprises contacting mogroside IIIE with a recombinant host cell that comprises a first gene encoding the first enzyme. In some embodiments, the first gene is heterologous to the recombinant host cell. In some embodiments, the mogroside IIIE contacts with the first enzyme in a recombinant host cell that comprises a first polynucleotide encoding the first enzyme. In some embodiments, the mogroside IIIE is present in the recombinant host cell. In some embodiments, the mogroside IIIE is produced by the recombinant host cell. In some embodiments, the method comprises cultivating the recombinant host cell in a culture medium under conditions in which the first enzyme is expressed. In some embodiments, the first enzyme is one or more of UDP glycosyltransferases, cyclomaltodextrin glucanotransferases (CGTases), glycotransferases, dextransucrases, cellulases, β-glucosidases, amylases, transglucosidases, pectinases, and dextranases. In some embodiments, the first enzyme is a CGTase. In some embodiments, the CGTase comprises an amino acid sequence having at least, 70%, 80%, 85%, 90%, 95%, 98%, 99%, 100%, or a range between any two of these numbers, sequence identity to the sequence of any one of SEQ ID NOs: 1, 3, 78-101, 148 and 154. In some embodiments, the transglucosidases are encoded by any one of SEQ ID NOs: 163-290 and 723. In some embodiments, the CGTases comprises, or consists of, a sequence set forth in any one of SEQ ID NOs: 1, 3, 78-101, 148, and 154. In some embodiments, the first enzyme is a dextransucrase. In some embodiments, the dextransucrase comprises an amino acid sequence having at least, 70%, 80%, 85%, 90%, 95%, 98%, 99%, 100%, or a range between any two of these numbers, sequence identity to the sequence of any one of SEQ ID NOs: 2, 103, 106-110, 156 and 896. In some embodiments, the DexT comprises an amino acid sequence any one of SEQ ID NOs: 2, 103, 106-110, 156 and 896. In some embodiments, the DexT comprises a nucleic acid sequence set forth in SEQ ID NO: 104 or 105. In some embodiments, the dextransucrase comprises an amino acid sequence of SEQ ID NO: 2 or 106-110. In some embodiments, the first enzyme is a transglucosidase. In some embodiments, the transglucosidase comprises an amino acid sequence having at least, 70%, 80%, 85%, 90%, 95%, 98%, 99%, 100%, or a range between any two of these numbers, sequence identity to the sequence of any one of SEQ ID NOs: 3163-291 and 723. In some embodiments, the transglucosidase comprises an amino acid sequence of SEQ ID NOs: 163-291 and 723. In some embodiments, the transglucosidases are encoded by any one of SEQ ID NOs: 163-291 and 723. In some embodiments, the transglucosidases comprises an amino acid sequence set forth by any one of SEQ ID NOs: 163-290 and 723. In some embodiments, the genes encode a CGTase comprising any one of the sequence set forth in SEQ ID NOs: 1, 3, 78-101, and 154.

In some embodiments, the method comprises contacting Mogroside IIA with the recombinant host cell to produce mogroside IIIE, wherein the recombinant host cell further comprises a second gene encoding a second enzyme capable of catalyzing production of Mogroside IIIE from Mogroside IIA. In some embodiments, the mogroside IIA is produced by the recombinant host cell. In some embodiments, the second enzyme is one or more of UDP glycosyltransferases, CGTases, glycotransferases, dextransucrases, cellulases, β-glucosidases, amylases, transglucosidases, pectinases, and dextranases. In some embodiments, the second enzyme is a uridine diphosphate-glucosyl transferase (UGT). In some embodiments, the transglucosidases comprises an amino acid sequence set forth by any one of SEQ ID NOs: 163-290 and 723. In some embodiments, the genes encode a CGTase comprising an amino acid sequences set forth in SEQ ID NOs: 1, 3, 78-101, 148, and 154. In some embodiments, the UGT is UGT73C3 (SEQ ID NO: 4), UGT73C6 (SEQ ID NO:5, 444 or 445), 85C2 (SEQ ID NO: 6), UGT73C5 (SEQ ID NO: 7), UGT73E1 (SEQ ID NO: 8), UGT98 (SEQ ID NO: 9 or 407). UGT1576 (SEQ ID NO: 15), UGT SK98 (SEQ ID NO: 16), UGT430 (SEQ ID NO: 17), UGT1697 (SEQ ID NO: 18), or UGT11789 (SEQ ID NO: 19) or any one of SEQ ID NOs: 4, 5, 7-9, 15-19, 125, 126, 128, 129, 293-304, 306, 307, 407, 439, 441, 444, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149. In some embodiments, the UGT is encoded by a nucleic acid sequence set forth in any one of UGT1495 (SEQ ID NO: 10), UGT1817 (SEQ ID NO: 11), UGT5914 (SEQ ID NO: 12), UGT8468 (SEQ ID NO: 13), UGT10391 (SEQ ID NO: 14), and SEQ ID Nos: 1050, 1052, 1054, 1056, 1058, 1060, 1062, 1064, 1066, 1068, 1070, 1075, 1077, 1079, 1081, 1083, 1085, 1087, 1089, 1091, and 1093.

In some embodiments, the method comprises contacting mogrol with the recombinant host cell to produce mogroside IIIE, wherein the recombinant host cell further comprises one or more genes encoding one or more enzymes capable of catalyzing production of mogroside IIIE from mogrol. In some embodiments, the mogrol is produced by the recombinant host cell. In some embodiments, the one or more enzymes comprises one or more of UDP glycosyltransferases, CGTases, glycotransferases, dextransucrases, cellulases, β-glucosidases, amylases, transglucosidases, pectinases, and dextranases. In some embodiments, the second enzyme is a uridine diphosphate-glucosyl transferase (UGT). In some embodiments, the UGT is UGT73C3, UGT73C6, 85C2, UGT73C5, UGT73E1, UGT98, UGT1495, UGT1817. UGT5914, UGT8468, UGT10391, UGT1576, UGT SK98, UGT430, UGT1697, or UGT11789.

In some embodiments, the method comprises contacting a mogroside compound with the recombinant host cell to produce mogroside IIIE, wherein the recombinant host cell further comprises one or more genes encoding one or more enzymes capable of catalyzing production of mogroside IIIE from the mogroside compound, wherein the mogroside compound is one or more of mogroside IA1, mogroside IE1, mogroside IIA1, mogroside IIE, mogroside IIIA1, mogroside IIIA2, mogroside III, mogroside IV, mogroside IVA, mogroside V, or siameside. In some embodiments, the mogroside compound is produced by the recombinant host cell. In some embodiments, the one or more enzymes comprises one or more of UDP glycosyltransferases, CGTases, glycotransferases, dextransucrases, cellulases, β-glucosidases, amylases, transglucosidases, pectinases, and dextranases. In some embodiments, the transglucosidases comprises an amino acid sequence set forth by any one of SEQ ID NOs: 163-290 and 723. In some embodiments, the genes encode a CGTase comprising an amino acid sequences set forth in SEQ ID NOs: 1, 3, 78-101, 148, and 154. In some embodiments, the method comprises contacting Mogroside IA1 with the recombinant host cell, wherein the recombinant host cell comprises a gene encoding UGT98 or UGT SK98. In some embodiments, the UGT98 or UGT SK98 enzyme comprises an amino acid sequence having at least, 70%, 80%, 85%, 90%, 95%, 98%, 99%, 100%, or a range between any two of these numbers, sequence identity to SEQ ID NO: 9, 407 or 16. In some embodiments, the contacting results in production of Mogroside IIA in the cell. In some embodiments, the one or more enzymes comprises an amino acid set forth by any one of SEQ ID NOs: 1, 3, 78-101, 106-109, 147, 154, 163-303, 405, 411, 354-405, 447-723, 770, 776, and 782.

In some embodiments, the method further comprises contacting 11-hydroxy-24,25 epoxy cucurbitadienol with the recombinant host cell, wherein the recombinant host cell further comprises a third gene encoding an epoxide hydrolase. In some embodiments, the 11-hydroxy-24,25 epoxy cucurbitadienol is produced by the recombinant host cell. In some embodiments, the method further comprises contacting 11-hydroxy-cucurbitadienol with the recombinant host cell, wherein the recombinant host cell comprises a fourth gene encoding a cytochrome P450 or an epoxide hydrolase. In some embodiments, the P450 polypeptide is encoded in genes comprising the sequence set forth in any one of SEQ ID NOs: 31-48, 316, 431, 871, 873, 875, 877, 879, 881, 883, 885, 887, and 891. In some embodiments, the 11-hydroxy-cucurbitadienol is produced by the recombinant host cell.

In some embodiments, the method further comprises contacting 3, 24, 25 trihydroxy cucurbitadienol with the recombinant host cell, wherein the recombinant host cell further comprises a fifth gene encoding a cytochrome P450. In some embodiments, the P450 polypeptide is encoded in genes comprising the sequence set forth in any one of SEQ ID NOS: 31-48, 316, 318, 1025, 1027, 1029, 1031, 1033, 1035, 1037, 1039, 1041, 1043, 1045, 1047, and 1049. In some embodiments, the 3, 24, 25 trihydroxy cucurbitadienol is produced by the recombinant host cell. In some embodiments, the contacting results in production of Mogrol in the recombinant host cell. In some embodiments, the cytochrome P450 comprises an amino acid sequence having at least, 70%, 80%, 85%, 90%, 95%, 98%, 99%, 100%, or a range between any two of these numbers, sequence identity to SEQ ID NO: 20, 308 or 315. In some embodiments, the P450 polypeptide is encoded in genes comprising the sequence set forth in any one SEQ ID NOs: 31-48, 316, 431, 871, 873, 875, 877, 879, 881, 883, 885, 887, 891, 1024, 1026, 1028, 1030, 1032, 1034, 1036, 1038, 1040, 1042, 1044, 1046, and 1048. In some embodiments, the epoxide hydrolase comprises an amino acid sequence having at least 70% of sequence identity to any one of SEQ ID NOs: 21-30 and 309-314.

In some embodiments, the method further comprises contacting cucurbitadienol with the recombinant host cell, wherein the recombinant host cell comprises a gene encoding cytochrome P450. In some embodiments, contacting results in production of 11-cucurbitadienol. In some embodiments, the 11-hydroxy cucurbitadienol is expressed in cells comprising a gene encoding CYP87D18 or SgCPR protein. In some embodiments, CYP87D18 or SgCPR comprises a sequence set forth in SEQ ID NO: 315, 872 or 874. In some embodiments, the CYP87D18 or SgCPR is encoded by SEQ ID NO: 316, 871 or 873. In some embodiments, the cucurbitadienol is produced by the recombinant host cell. In some embodiments, the gene encoding cytochrome P450 comprises a nucleic acid sequence having at least, 70%, 80%, 85%, 90%, 95%, 98%, 99%, 100%, or a range between any two of these numbers, sequence identity to any one of SEQ ID Nos: 31-48, 316, 431, 871, 873, 875, 877, 879, 881, 883, 885, 887, and 891. In some embodiments, the cytochrome P450 comprises an amino acid sequence having at least, 70%, 80%, 85%, 90%, 95%, 98%, 99%, 100%, or a range between any two of these numbers, sequence identity to SEQ ID NOs: 31-48, 316, 431, 871, 873, 875, 877, 879, 881, 883, 885, 887, 891, 1025, 1027, 1029, 1031, 1033, 1035, 1037, 1039, 1041, 1043, 1045, 1047, and 1049. In some embodiments, the P450 polypeptide is encoded in genes comprising the sequence set forth in any one of SEQ ID NOs: 31-48, 316, 431, 871, 873, 875, 877, 879, 881, 883, 885, 887, 891, 1024, 1026, 1028, 1030, 1032, 1034, 1036, 1038, 1040, 1042, 1044, 1046, and 1048.

In some embodiments, the method further comprises contacting 2,3-oxidosqualene with the recombinant host cell, wherein the recombinant host cell comprises a seventh gene encoding cucurbitadienol synthase. In some embodiments, he cucurbitadienol synthase comprises an amino acid sequence set forth in SEQ ID NO: 70-73, 75-77, 319, 321, 323, 325, 327-333, 420, 422, 424, 426, 446, 902, 904 or 906. In some embodiments, the cucurbitadienol synthase is encoded by any one sequence set forth in SEQ ID NOs: 74, 320, 322, 324, 326, 328, 418, 421, 423, 425, 427, 897, 899, 901, 903 and 905. In some embodiments, the contacting results in production of cucurbitadienol. In some embodiments, the 2,3-oxidosqualene is produced by the recombinant host cell. In some embodiments, the 2,3-oxidosqualene or diepoxysqualene is produced by an enzyme comprising a sequence set forth in SEQ ID NO: 898 or 900. In some embodiments, the 2,3-oxidosqualene or diepoxysqualene is produced by an enzyme encoded by a nucleic acid sequence set forth in SEQ ID NO: 897 or 899.

In some embodiments, the cucurbitadienol synthase is encoded by a gene comprising a sequence set forth in SEQ ID NO: 74. In some embodiments, the cucurbitadienol synthase is encoded by a gene comprising a nucleic acid sequence set forth in any one of SEQ ID NOs: 74, 320, 322, 324, 326, 328, 418, 421, 423, 425, 427, 897, 899, 901, 903, and 905. In some embodiments, 11-hydroxy cucurbitadienol is produced by the cell. In some embodiments, 11-OH cucurbitadienol is expressed in cells comprising a gene encoding CYP87D18 or SgCPR protein. In some embodiments, CYP87D18 or SgCPR comprises a sequence set forth in SEQ ID NO: 315, 872 or 874. In some embodiments, the CYP87D18 or SgCPR is encoded by SEQ ID NO: 316, 871 or 873. In some embodiments, the cucurbitadienol synthase polypeptide comprises a C-terminal portion comprising the sequence set forth in SEQ ID NO: 73. In some embodiments, the gene encoding the cucurbitadienol synthase polypeptide is codon optimized. In some embodiments, the codon optimized gene comprises the nucleic acid sequence set forth in SEQ ID NO: 74. In some embodiments, the cucurbitadienol synthase comprises an amino acid sequence having at least 70% sequence identity to any one of SEQ ID NOs: 70-73, 75-77, 319, 321, 323, 325, 327-333, 420, 422, 424, 426, 446, 902, 904, and 906 (which include, for example, cucurbitadienol synthases from *C pepo, S grosvenorii, C sativus, C melo, C moschata*, and *C maxim*). In some embodiments, the cucurbitadienol synthase polypeptide comprises a C-terminal portion comprising the sequence set forth in SEQ ID NO: 73. In some embodiments, the gene encoding the cucurbitadienol synthase polypeptide is codon optimized. In some embodiments, the codon optimized gene comprises the nucleic acid sequence set forth in SEQ ID NO: 74. In some embodiments, the cucurbitadienol synthase comprises an amino acid comprising the polypeptide from *Lotus japonicas* (BAE53431), *Populus trichocarpa* (XP_002310905), *Actaea racemosa* (ADC84219), *Betula platyphylla* (BAB83085), *Glycyrrhiza glabra* (BAA76902), *Vitis vinifera* (XP_002264289), *Centella asiatica* (AAS01524), *Panax ginseng* (BAA33460), and *Betula platyphylla* (BAB83086), as described in WO 2016/050890, incorporated by reference in its entirety herein.

In some embodiments, the method comprises contacting squalene with the recombinant host cell, wherein the recombinant host cell comprises an eighth gene encoding a squalene epoxidase. In some embodiments, the contacting results in production of 2, 3-oxidosqualene. In some embodiments, the squalene is produced by the recombinant host cell. In some embodiments, the squalene epoxidase comprises an amino acid sequence having at least, 70%, 80%, 85%, 90%, 95%, 98%, 99%, 100%, or a range between any two of these numbers, sequence identity to SEQ ID NOs: 50-56, 60, 61, 334 or 335.

In some embodiments, the method comprises contacting farnesyl pyrophosphate with the recombinant host cell, wherein the recombinant host cell comprises a ninth gene encoding a squalene synthase. In some embodiments, the contacting results in production of squalene. In some embodiments, the farnesyl pyrophosphate is produced by the recombinant host cell. In some embodiments, the squalene synthase comprises an amino acid sequence having at least, 70%, 80%, 85%, 90%, 95%, 98%, 99%, 100%, or a range between any two of these numbers, sequence identity to SEQ ID NO: 69 or 336.

In some embodiments, the method further comprises contacting geranyl-PP with the recombinant host cell, wherein the recombinant host cell comprises a tenth gene encoding farnesyl-PP synthase. In some embodiments, the contacting results in production of farnesyl-PP. In some embodiments, the geranyl-PP is produced by the recombinant host cell. In some embodiments, the farnesyl-PP synthase comprises an amino acid sequence having at least, 70%, 80%, 85%, 90%, 95%, 98%, 99%, 100%, or a range between any two of these numbers, sequence identity to SEQ ID NO: 338. In some embodiments, one or more of the first, second third, fourth, fifth, sixth, seventh, eighth, ninth, and tenth gene is operably linked to a heterologous promoter. In some embodiments, the heterologous promoter is a CMV, EF1a, SV40, PGK1, human beta actin, CAG, GAL1, GAL10, TEF1, GDS, ADH1, CaMV35S, Ubi, T7, T7lac, Sp6, araBAD, trp, Lac, Ptac, pL promoter, or a combination thereof. In some embodiments, the promoter is an inducible, repressible, or constitutive promoter. In some embodiments, production of one or more of pyruvate, acetyl-CoA, citrate, and TCA cycle intermediates have been upregulated in the recombinant host cell. In some embodiments, cytosolic localization has been upregulated in the recombinant host cell. In some embodiments, one or more of the first, second, third, fourth, fifth, sixth, seventh, eighth, ninth, and tenth gene comprises at least one sequence encoding a 2A self-cleaving peptide. As used herein, the terms the first, the second, the third, the fourth, the fifth, the sixth, the seventh, the eighth, the ninth, the tenth, and alike do not infer particular order and/or a requirement for presence of the earlier number. For example, the recombinant host cell described herein can comprise the first gene and the third gene, but not the second gene. As another example, the recombinant host cell can comprise the first gene, the fifth gene, and the tenth gene, but not the second gene, the third gene, the fourth gene, the sixth gene, the seventh gene, the eighth gene, and the ninth gene.

The recombinant host cell can be, for example, a plant, bivalve, fish, fungus, bacteria or mammalian cell. For example, the plant is selected from *Siraitia, Momordica, Gynostemma, Cucurbita, Cucumis, Arabidopsis, Artemisia, Stevia, Panax, Withania, Euphorbia, Medicago, Chlorophytum, Eleutherococcus, Aralia, Morus, Medicago, Betula, Astragalus, Jatropha, Camellia, Hypholoma, Aspergillus, Solanum, Huperzia, Pseudostellaria, Corchorus, Hedera, Marchantia,* and *Morus*. In some embodiments, fungus is selected from *Trichophyton, Sanghuangporus, Taiwanofungus, Moniliophthora, Marssonina, Diplodia, Lentinula, Xanthophyllomyces, Pochonia, Colletotrichum, Diaporthe, Histoplasma, Coccidioides, Histoplasma, Sanghuangporus, Aurcobasidium, Pochonia, Penicillium, Sporothrix, Metarhizium, Aspergillus, Yarrowia,* and *Lipomyces*. In some embodiments, the fungus is *Aspergillus nidulans, Yarrowia lipolytica,* or *Rhodosporin toruloides*. In some embodiments, the recombinant host cell is a yeast cell. In some embodiments, the yeast is selected from *Candida*, Sacccharaomyces, Saccharomycotina, Taphrinomycotina, *Schizosaccharomyces, Komagataella, Basidiomycota, Agaricomycotina, Tremellomycetes, Pucciniomycotina, Aureobasidium, Coniochaeta, Rhodosporidium,* and *Microboryomycetes*. In some embodiments, the bacteria is selected from *Frankia, Actinobacteria, Streptomyces, Enterococcus,* In some embodiments, the bacteria is *Enterococcus faecalis*. In some embodiments, one or more of the first, second third, fourth, fifth, sixth, seventh, eighth, ninth, and tenth genes has been codon optimized for expression in a bacterial, mammalian, plant, fungal or insect cell. In some embodiments, one or more of the first, second third, fourth, fifth, sixth, seventh, eighth, ninth, and tenth genes comprises a functional mutation to increased activity of the encoded enzyme. In some embodiments, cultivating the recombinant host cell comprises monitoring the cultivating for pH, dissolved oxygen level, nitrogen level, or a combination thereof of the cultivating conditions. In some embodiments, the method comprises isolating Compound 1. In some embodiments, isolating Compound 1 comprises lysing the recombinant host cell. In some embodiments, isolating Compound 1 comprises isolating Compound 1 from the culture medium. In some embodiments, the method comprises purifying Compound 1. In some embodiments, purifying Compound 1 comprises HPLC, solid phase extraction or a combination thereof. In some embodiments, the purifying comprises harvesting the recombinant cells, saving the supernatant and lysing the cells. In some embodiments, the lysing comprises subjecting the cells to shear force or detergent washes thereby obtaining a lysate. In some embodiments, the shear force is from a sonication method, french pressurized cells, or beads. In some embodiments, the lysate is subjected to filtering and purification steps. In some embodiments, the lysate is filtered and purified by solid phase extraction.

In some embodiments, a compound having the structure of Compound 1,

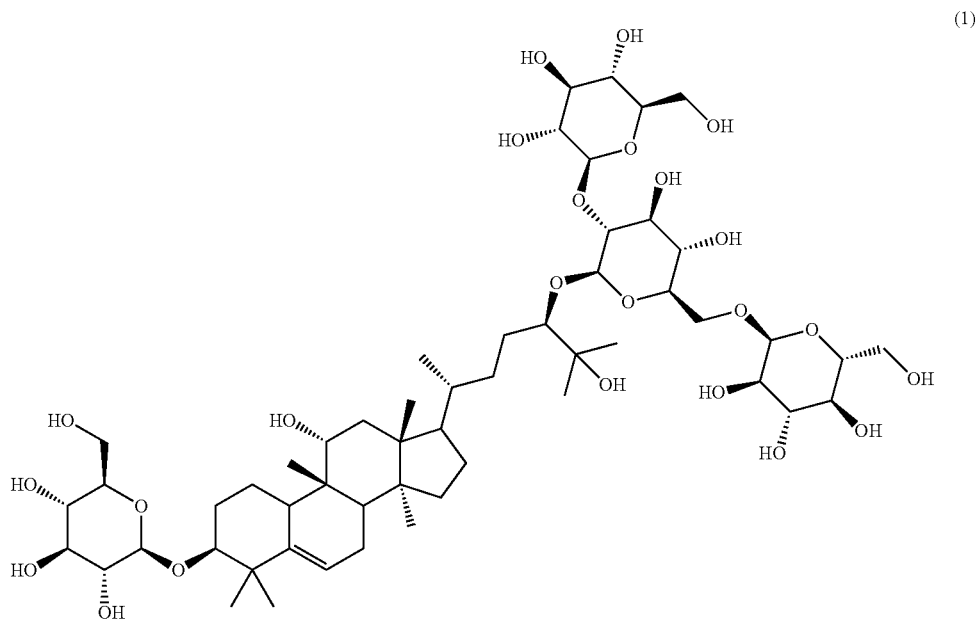 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

is provided, wherein the compound is produced by the method of any one of the alternative methods provided herein.

In some embodiments, a cell lysate comprising Compound 1 having the structure:

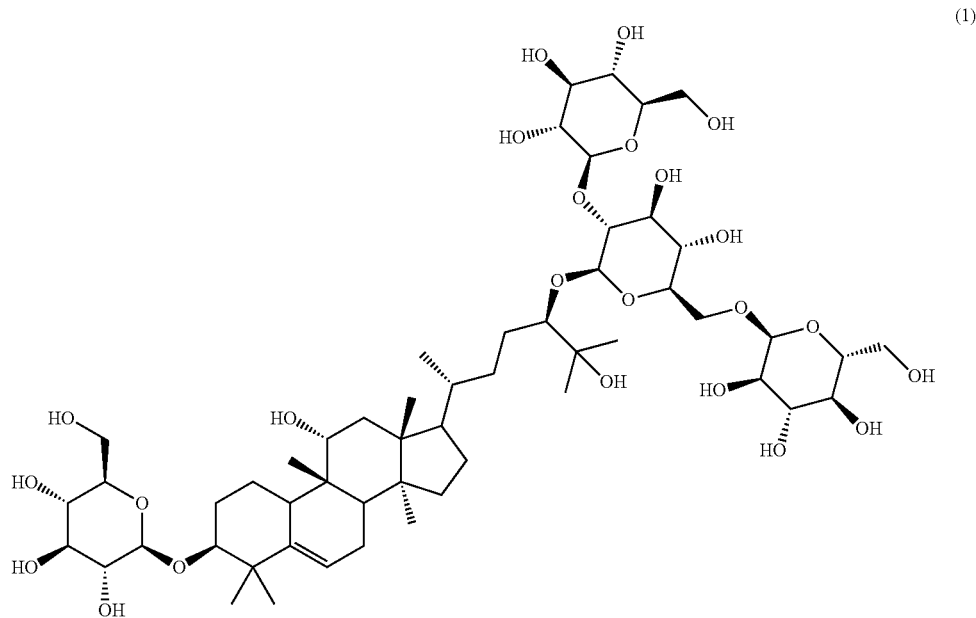 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

is provided.

In some embodiments, a recombinant cell comprising:
Compound 1 having the structure:

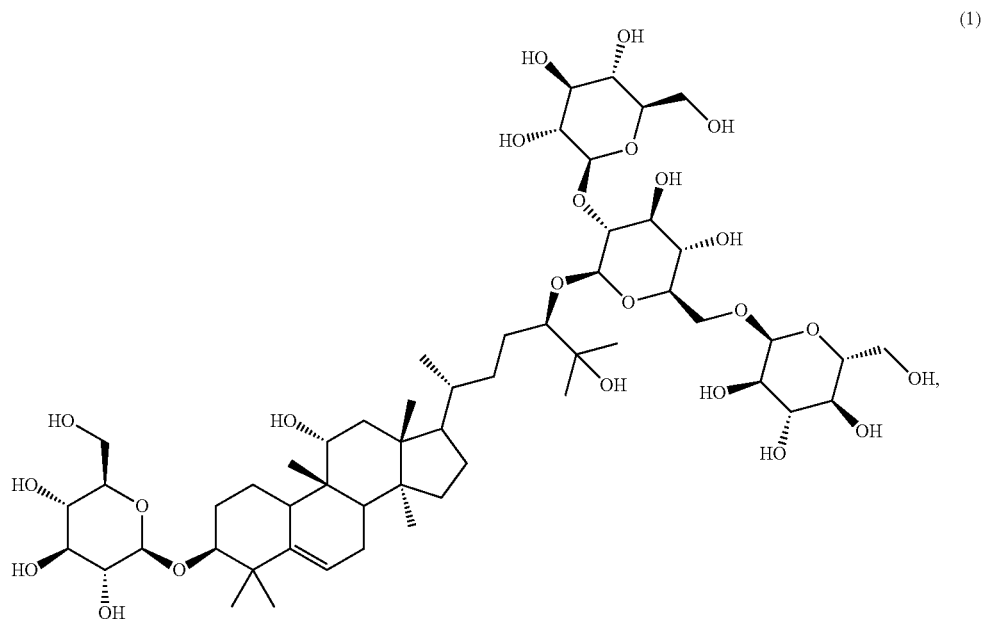 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

is provided, and a gene encoding an enzyme capable of catalyzing production of Compound 1 from mogroside IIIE. In some embodiments, the gene is a heterologous gene to the recombinant cell.

In some embodiments, a recombinant cell comprising a first gene encoding a first enzyme capable of catalyzing production of Compound 1 having the structure:

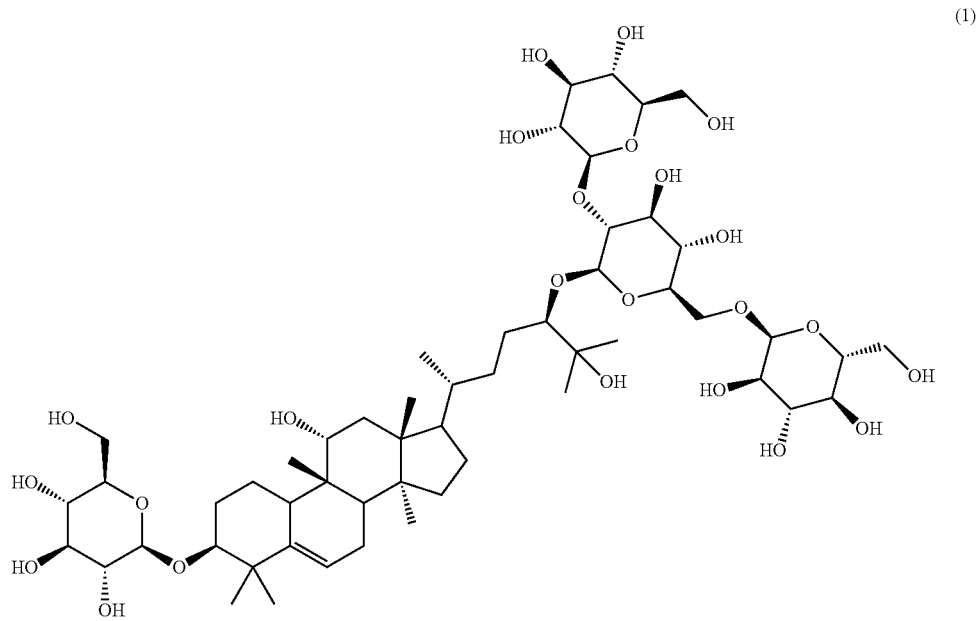 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

from mogroside IIIE is provided. In some embodiments, the first enzyme comprises an amino acid sequence having at least, 70%, 80%, 85%, 90%, 95%, 98%, 99%, 100%, or a range between any two of these numbers, sequence identity to SEQ ID NO: 1, 3, 78-101, 148, or 154 (CGTase). In some embodiments, the first enzyme comprises the amino acid sequence of SEQ ID NOs: 1, 3, 78-101, 148, or 154 (CGTase). In some embodiments, the first enzyme is a dextransucrase. In some embodiments, the dextransucrase comprises, or consists of, an amino acid sequence having at least, 70%, 80%, 85%, 90%, 95%, 98%, 99%, 100%, or a range between any two of these numbers, sequence identity to any one of SEQ ID NOs: 2, 103, 106-110, 156, and 896. In some embodiments, the dextransucrase comprises, or consists of, the amino acid sequence of SEQ ID NO: 2, 103, 104, or 105. In some embodiments, the dextransucrase comprises, or consists of, the amino acid sequence of any one of SEQ ID NO: 2, 103-110 and 156-162 and 896. In some embodiments, the DexT comprises a nucleic acid sequence set forth in SEQ ID NO: 104 or 105. In some embodiments, the first enzyme is a transglucosidase. In some embodiments, the transglucosidase comprises an amino acid sequence having at least, 70%, 80%, 85%, 90%, 95%, 98%, 99%, 100%, or a range between any two of these numbers, sequence identity to the sequence of SEQ ID NO: 201 or SEQ ID NO: 291. In some embodiments, the recombinant cell further comprises a second gene encoding a uridine diphosphate-glucosyl transferase (UGT). In some embodiments, the UGT comprises an amino acid sequence having at least, 70%, 80%, 85%, 90%, 95%, 98%, 99%, 100%, or a range between any two of these numbers, sequence identity to any one of SEQ ID NOs: 4, 5, 6, 7, 8, 9, 15, 16, 17, 18, 19, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149. In some embodiments, UGT comprises, or consists of, the amino acid sequence of any one of SEQ ID NOs: 4, 5, 6, 7, 8, 9, 15, 16, 17, 18, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149. In some embodiments, the UGT is encoded by a sequence set forth in UGT1495 (SEQ ID NO: 10), UGT1817 (SEQ ID NO: 11), UGT5914 (SEQ ID NO: 12), UGT8468 (SEQ ID NO: 13), or UGT10391 (SEQ ID NO: 14), or any one of SEQ ID NOs: 1050, 1052, 1054, 1056, 1058, 1060, 1062, 1064, 1066, 1068, 1070, 1075, 1077, 1079, 1081, 1083, 1085, 1087, 1089, 1091, and 1093. In some embodiments, the cell comprises a third gene encoding UGT98 or UGT SK98. In some embodiments, the UGT98 or UGT SK98 comprises an amino acid sequence having at least, 70%, 80%, 85%, 90%, 95%, 98%, 99%, 100%, or a range between any two of these numbers, sequence identity to SEQ ID NO: 9, 407 or 16. In some embodiments, the cell comprises a fourth gene encoding an epoxide hydrolase. In some embodiments, the epoxide hydrolase comprises an amino acid sequence having at least, 70%, 80%, 85%, 90%, 95%, 98%, 99%, 100%, or a range between any two of these numbers, sequence identity to any one of SEQ ID NOs: 21-30 and 309-314. In some embodiments, the cell comprises a fifth sequence encoding P450. In some embodiments, the P450 comprises an amino acid sequence having at least, 70%, 80%, 85%, 90%, 95%, 98%, 99%, 100%, or a range between any two of these numbers, sequence identity to SEQ ID NOs: 20, 49, 308, 315 or 317. In some embodiments, P450 is encoded by a gene comprising a sequence set forth in any one of SEQ ID NOs: 31-48, 316, 431, 871, 873, 875, 877, 879, 881, 883, 885, 887, and 891. In some embodiments, further comprises a sixth sequence encoding cucurbitadienol synthase. In some embodiments, the cucurbitadienol synthase comprises an amino acid sequence having at least, 70%, 80%, 85%, 90%, 95%, 98%, 99%, 100%, or a range between any two of these numbers, sequence identity to any one of SEQ ID NOs: 70-73, 75-77, 319, 321, 323, 325, 327-333, 420, 422, 424, 426, 446, 902, 904, and 906. In some embodiments, the cucurbitadienol synthase polypeptide comprises a C-terminal portion comprising the sequence set forth in SEQ ID NO: 73. In some embodiments, the gene encoding the cucurbitadienol synthase polypeptide is codon optimized. In some embodiments, the codon optimized gene comprises the nucleic acid sequence set forth in SEQ ID NO: 74. In some embodiments, the cell further comprises a seventh gene encoding a squalene epoxidase. In some embodiments, the squalene epoxidase comprises an amino acid sequence having at least, 70%, 80%, 85%, 90%, 95%, 98%, 99%, 100%, or a range between any two of these numbers, sequence identity to any one of SEQ ID NOs: 50-56, 60, 61, 334, and 335. In some embodiments, the cell further comprises an eighth gene encoding a squalene synthase. In some embodiments, the eighth gene comprises an amino acid sequence having at least, 70%, 80%, 85%, 90%, 95%, 98%, 99%, 100%, or a range between any two of these numbers, sequence identity to SEQ ID NO: 69 or SEQ ID NO: 336. In some embodiments, the cell further comprises a ninth gene encoding a farnesyl-PP synthase. In some embodiments, the farnesyl-PP synthase comprises an amino acid sequence having at least, 70%, 80%, 85%, 90%, 95%, 98%, 99%, 100%, or a range between any two of these numbers, sequence identity to SEQ ID NO: 338. In some embodiments, the cell is a mammalian, bacterial, fungal, or insect cell. In some embodiments, the cell is a yeast cell. Non-limiting examples of the yeast include *Candida, Sacccharaomyces, Saccharomycotina, Taphrinomycotina, Schizosaccharomyces, Komagataella, Basidiomycota, Agaricomycotina, Tremellomycetes, Pucciniomycotina, Aurcobasidium, Coniochacta*, and *Microboryomycetes*. In some embodiments, the plant is selected from the group consisting of *Siraitia, Momordica, Gynostemma, Cucurbita, Cucumis, Arabidopsis, Artemisia, Stevia, Panax, Withania, Euphorbia, Medicago, Chlorophytum, Eleutherococcus, Aralia, Morus, Medicago, Betula, Astragalus, Jatropha, Camellia, Hypholoma, Aspergillus, Solanum, Huperzia, Pseudostellaria, Corchorus, Hedera, Marchantia*, and *Morus*. In some embodiments, the fungus is *Trichophyton, Sanghuangporus, Taiwanofungus, Moniliophthora, Marssonina, Diplodia, Lentinula, Xanthophyllomyces, Pochonia, Colletotrichum, Diaporthe, Histoplasma, Coccidioides, Histoplasma, Sanghuangporus, Aureobasidium, Pochonia, Penicillium, Sporothrix*, or *Metarhizium*.

In some embodiments, the cell comprises a sequence of an enzyme set forth in any one of SEQ ID NO: 897, 899, 909, 911, 913, 418, 421, 423, 425, 427, 871, 873, 901, 903 or 905. In some embodiments, the enzyme comprises a sequence set forth in or is encoded by a sequence in SEQ ID NO: 420, 422, 424, 426, 446, 872, 874-896, 898, 900, 902, 904, 906, 908, 910, 912, and 951-1012.

In some embodiments, DNA can be obtained through gene synthesis. This can be performed by either through Genescript or IDT, for example. DNA can be cloned through standard molecular biology techniques into an overexpression vector such as: pQE1, pGEX-4t3, pDest-17, pET series, pFASTBAC, for example. *E. coli* host strains can be used to produce enzyme (i.e., Top10 or BL21 series +/− codon plus) using 1 mM IPTG for induction at OD600 of 1. *E. coli* strains can be propagated at 37 C, 250 rpm and switched to room temperature or 30 C (150 rpm) during induction. When indicated, some enzymes can also be expressed through SF9 insect cell lines using pFASTBAC and optimized MOI. Crude extract containing enzymes can be generated through sonication and used for the reactions described herein. All UDP-glycosyltransferase reactions contain sucrose synthase, and can be obtained from *A. thaliana* via gene synthesis and expressed in *E. coli*.

Hydrolysis of Hyper-Glycosylated Mogrosides to Produce Compound 1

In some embodiments, hyper-glycosylated mogrosides can be hydrolyzed to produce Compound 1. Non-limiting examples of hyper-glycosylated mogrosides include Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III. Enzymes capable of catalyzing the hydrolysis process to produce Compound 1 can be, for example, CGTases (e.g., displays hydrolysis without starch), cellulases, β-glucosidases, transglucosidases, amylases, pectinases, dextranases, and fungal lactases.

In some embodiments, Compound 1 displays tolerance to hydrolytic enzymes in the recombinant cell, wherein the hydrolytic enzymes display capabilities of hydrolyzing Mogroside VI, Mogroside V. Mogroside IV to Mogroside IIIE. The alpha-linked glycoside present in Compound 1 provides a unique advantage over other Mogrosides (beta-linked glycosides) due to its tolerance to hydrolysis. During microbial production of Compound 1, the recombinant host cells (e.g., microbial host cells) can hydrolyze unwanted beta-linked Mogrosides back to Mogroside IIIE. Without being bound by any particular theory, it is believed that the hydrolysis by the host cells can improve the purity of Compound 1 due to: 1) Reduction of unwanted Mogroside VI. Mogroside V, and Mogroside IV levels, and/or 2) The hydrolysis will increase the amount of Mogroside IIIE available to be used as a precursor for production of Compound 1.

Purification of Mogroside Compounds

Some embodiments comprise isolating mogroside compounds, for example Compound 1. In some embodiments, isolating Compound 1 comprises lysing the recombinant host cell. In some embodiments, isolating Compound 1 comprises isolating Compound 1 from the culture medium. In some embodiments, the method further comprises purifying Compound 1. In some embodiments, purifying Compound 1 comprises HPLC, solid phase extraction or a combination thereof. In some embodiments, the purifying comprises harvesting the recombinant cells, saving the supernatant and lysing the cells. In some embodiments, the lysing comprises subjecting the cells to shear force or detergent washes thereby obtaining a lysate. In some embodiments, the shear force is from a sonication method, french pressurized cells, or beads. In some embodiments, the lysate is subjected to filtering and purification steps. In some embodiments, the lysate is filtered and purified by solid phase extraction. The lysate can then be filtered and treated with ammonium sulfate to remove proteins, and fractionated on a C18 HPLC (5×10 cm Atlantis prep T3 OBD column, 5 um, Waters) and by injections using an A/B gradient (A=water B=acetonitrile) of 10→30% B over 30 minutes, with a 95% B wash, followed by re-equilibration at 1% (total run time=42 minutes). The runs can be collected in tared tubes (12 fractions/plate, 3 plates per run) at 30 mL/fraction. The lysate can also be centrifuged to remove solids and particulate matter. Plates can then be dried in the Genevac HT12/HT24. The desired compound is expected to be eluted in Fraction 21 along with other isomers. The pooled Fractions can be further fractionated in 47 runs on fluoro-phenyl HPLC column (3×10 cm, Xselect fluoro-phenyl OBD column, 5 um, Waters) using an A/B gradient (A=water, B=acetonitrile) of 15→30% B over 35 minutes, with a 95% B wash, followed by re-equilibration at 15% (total run time=45 minutes). Each run was collected in 12 tared tubes (12 fractions/plate, 1 plate per run) at 30 mL/fraction. Fractions containing the desired peak with the desired purity can be pooled based on UPLC analysis and dried under reduced pressure to give a whitish powdery solid. The pure compound can be re-suspended/dissolved in 10 mL of water and lyophilized to obtain at least a 95% purity.

For purification of Compound 1, in some embodiments, the compound can be purified by solid phase extraction, which may remove the need to HPLC. Compound 1 can be purified, for example, to or to about 70%, 80%, 90%, 95%, 98%, 99%, or 100% purity or any level of purity within a range described by any two aforementioned values. In some embodiments, compound 1 that is purified by solid phase extraction is, or is substantially, identical to the HPLC purified material. In some embodiments, the method comprises fractionating lysate from a recombinant cell on an HPLC column and collecting an eluted fraction comprising Compound 1.

Fermentation

Host cells can be fermented as described herein for the production of Compound 1. This can also include methods that occur with or without air and can be carried out in an anaerobic environment, for example. The whole cells (e.g., recombinant host cells) may be in fermentation broth or in a reaction buffer.

Monk fruit (*Siraitia grosvenorii*) extract can also be used to contact the cells in order to produce Compound 1. In some embodiments, a method of producing Compound 1 is provided. The method can comprise contacting monk fruit extract with a first enzyme capable of catalyzing production of Compound 1 from a mogroside such as such as Mogroside V. Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III. In some embodiments, the contacting comprises contacting the mogrol fruit extract with a recombinant host cell that comprises a first gene encoding the first enzyme. In some embodiments, the first gene is heterologous to the recombinant host cell. In some embodiments, the mogrol fruit extract contacts with the first enzyme in a recombinant host cell that comprises a first polynucleotide encoding the first enzyme. In some embodiments, mogroside IIIE is in the mogrol fruit extract. In some embodiments, mogroside IIIE is also produced by the recombinant host cell. In some embodiments, the method further comprises cultivating the recombinant host cell in a culture medium under conditions in which the first enzyme is expressed. In some embodiments, the first enzyme is one or more of UDP glycosyltransferases, cyclomaltodextrin glucanotransferases (CGTases), glycotransferases, dextransucrases, cellulases, β-glucosidases, amylases, transglucosidases, pectinases, and dextranases. In some embodiments, the first enzyme is a CGTase. For example, the CGTase can comprise an amino acid sequence having at least 70%, at least 80%, at least 90%, at least 95%, at least 98%, at least 99%, or more sequence identity to the sequence of any one of SEQ ID NO: SEQ ID NOs: 1, 3, 78-101, 148, and 154. In some embodiments, the CGTase comprises the amino acid sequence of any one of SEQ ID NOs: SEQ ID NOs: 1, 3, 78-101, 148, and 154. In some embodiments, the CGTase comprises the amino acid sequence of any one of SEQ ID NOs: 78-101. In some embodiments, the first enzyme is a dextransucrase. In some embodiments, the dextransucrase comprises an amino acid sequence having at least, 70%, 80%, 85%, 90%, 95%, 98%, 99%, 100%, or a range between any two of these numbers, sequence identity to any one of the sequences set forth in SEQ ID NOs: 2, 103, 106-110, 156 and 896. In some embodiments, the dextransucrase comprises an amino acid sequence of any one of SEQ ID NOs: 2, 103, 106-110, 156 and 896. In some embodiments, the first enzyme is a transglucosidase. In some embodiments, the transglucosidase comprises an amino acid sequence having at least, 70%, 80%, 85%, 90%, 95%, 98%, 99%, 100%, or a range between any two of these numbers, sequence identity to the sequence of any one of SEQ ID NOs: 163-290 and 723. In some embodiments, the transglucosidase comprises an amino acid sequence of any one of SEQ ID NOs: 163-290 and 723. In some embodiments, the first enzyme is a beta-glucosidase. In some embodiments, the beta glucosidase comprises an amino acid sequence set forth in SEQ ID NO: 292, or an amino acid sequence having at least, 70%, 80%, 85%, 90%, 95%, 98%, 99%, 100%, or a range between any two of these numbers, sequence identity to SEQ ID NO: 292. In some embodiments, the mogrol fruit extract comprises Mogroside IIA and the recombinant host cell comprises a second gene encoding a second enzyme capable of catalyzing production of Mogroside IIIE from Mogroside IIA. In some embodiments, mogroside IIA is also produced by the recombinant host cell. In some embodiments, the second enzyme is one or more of UDP glycosyltransferases, CGTases, glycotransferases, dextransucrases, cellulases, β-glucosidases, amylases, transglucosidases, pectinases, and dextranases. In some embodiments, the second enzyme is a uridine diphosphate-glucosyl transferase (UGT). In some embodiments, the UGT is UGT73C3 (SEQ ID NO: 4), UGT73C6 (SEQ ID NO:5, 444, or 445), 85C2 (SEQ ID NO: 6), UGT73C5 (SEQ ID NO: 7), UGT73E1 (SEQ ID NO: 8), UGT98 (SEQ ID NO: 9 or 407), UGT1576 (SEQ ID NO:15), UGT SK98 (SEQ ID NO: 16), UGT430 (SEQ ID NO: 17), UGT1697 (SEQ ID NO: 18), UGT11789 (SEQ ID NO: 19), or comprises an amino acid sequence having at least, 70%, 80%, 85%, 90%, 95%, 98%, 99%, 100%, or a range between any two of these numbers, sequence identity to UGT73C3 (SEQ ID NO: 4), UGT73C6 (SEQ ID NO:5, 444 or 445), 85C2 (SEQ ID NO: 6), UGT73C5 (SEQ ID NO: 7), UGT73E1 (SEQ ID NO: 8), UGT98 (SEQ ID NO: 9 or 407), UGT1576 (SEQ ID NO:15), UGT SK98 (SEQ ID NO:16), UGT430 (SEQ ID NO:17), UGT1697 (SEQ ID NO:18), UGT11789 (SEQ ID NO:19). In some embodiments, the UGT is encoded by a gene set forth in UGT1495 (SEQ ID NO: 10), UGT1817 (SEQ ID NO: 11), UGT5914 (SEQ ID NO: 12), UGT8468 (SEQ ID NO: 13) or UGT10391 (SEQ ID NO:14). In some embodiments, the monk fruit extract comprises mogrol. In some embodiments, the method further comprises contacting the mogrol of the monk fruit extract wherein the recombinant host cell further comprises one or more genes encoding one or more enzymes capable of catalyzing production of Mogroside IIIE from mogrol. In some embodiments, mogrol is also produced by the recombinant host cell. In some embodiments, the one or more enzymes comprises one or more of UDP glycosyltransferases, CGTases, glycotransferases, dextransucrases, cellulases, β-glucosidases, amylases, transglucosidases, pectinases, and dextranases. In some embodiments, the second enzyme is a uridine diphosphate-glucosyl transferase (UGT). In some embodiments, the UGT is UGT73C3, UGT73C6, 85C2, UGT73C5, UGT73E1, UGT98, UGT1495, UGT1817, UGT5914, UGT8468, UGT10391, UGT1576, UGT SK98, UGT430, UGT1697, or UGT11789, or comprises an amino acid sequence having at least, 70%, 80%, 85%, 90%, 95%, 98%, 99%, 100%, or a range between any two of these numbers, sequence identity to those UGTs. In some embodiments, the method further comprises contacting the monk fruit extract with the recombinant host cell to produce mogroside IIIE, wherein the recombinant host cell further comprises one or more genes encoding one or more enzymes capable of catalyzing production of Mogroside IIIE from the mogroside compound, wherein the mogroside compound is one or more of mogroside IA1, mogroside IE1, mogroside IIA1, mogroside IIE, mogroside IIA, mogroside IIIA1, mogroside IIIA2, mogroside III, mogroside IV, mogroside IVA, mogroside V, or siamenoside. In some embodiments, a mogroside compound is also produced by the recombinant host cell. In some embodiments, the one or more enzymes comprises one or more of UDP glycosyltransferases, CGTases, glycotransferases, dextransucrases, cellulases, β-glucosidases, amylases, transglucosidases, pectinases, and dextranases. In some embodiments, the mogroside compound is Mogroside IIE. In some embodiments, the one or more enzymes is comprises an amino acid set forth by any one of SEQ ID NOs: 293-303. In some embodiments, the mogroside compound is Morgroside IIA or Mogroside IIE, and wherein contacting the monk fruit extract with the recombinant cell expressing the one or more enzymes produces Mogroside IIIA, Mogroside IVE and Mogroside V. In some embodiments, the one or more enzymes comprise an amino acid set forth in SEQ ID NO: 304. In some embodiments, the one or more enzymes is encoded by a sequence set forth in SEQ ID NO: 305. In some embodiments, the monk fruit extract comprises Mogroside IA1. In some embodiments, the method further comprises contacting the monk fruit extract with the recombinant host cell, wherein the recombinant host cell comprises a gene encoding UGT98 or UGT SK98. In some embodiments, the UGT98 or UGT SK98 enzyme comprises an amino acid sequence having at least, 70%, 80%, 85%, 90%, 95%, 98%, 99%, 100%, or a range between any two of these numbers, sequence identity to SEQ ID NO: 9, 407, 16 or 306. In some embodiments, the UGT98 is encoded by a sequence set forth in SEQ ID NO: 307. In some embodiments, the contacting results in production of Mogroside IIA in the cell. In some embodiments, the monk fruit extract comprises 11-hydroxy-24,25 epoxy cucurbitadienol. In some embodiments, the method further comprises contacting monk fruit extract with the recombinant host cell, wherein the recombinant host cell further comprises a third gene encoding an epoxide hydrolase. In some embodiments, the 11-hydroxy-24,25 epoxy cucurbitadienol is also produced by the recombinant host cell. In some embodiments, the method further comprises contacting monk fruit extract with the recombinant host cell, wherein the recombinant host cell comprises a fourth gene encoding a cytochrome P450 or an epoxide hydrolase. In some embodiments, the 11-hydroxy-cucurbitadienol is also produced by the recombinant host cell. In some embodiments, the monk fruit extract comprises 3, 24, 25 trihydroxy cucurbitadienol. In some embodiments, the method further comprises contacting monk fruit extract with the recombinant host cell, wherein the recombinant host cell further comprises a fifth gene encoding a cytochrome P450. In some embodiments, the 3, 24, 25 trihydroxy cucurbitadienol is also produced by the recombinant host cell. In some embodiments, the contacting with mogrol fruit extract results in production of Mogrol in the recombinant host cell. In some embodiments, the cytochrome P450 comprises an amino acid sequence having at least, 70%, 80%, 85%, 90%, 95%, 98%, 99%, 100%, or a range between any two of these numbers, sequence identity to SEQ ID NO: 20 or 308. In some embodiments, the epoxide hydrolase comprises an amino acid sequence having at least, 70%, 80%, 85%, 90%, 95%, 98%, 99%, 100%, or a range between any two of these numbers, sequence identity to any one of SEQ ID NOs: 21-30 and 309-314. In some embodiments, the monk fruit extract comprises cucurbitadienol. In some embodiments, the method further comprises contacting cucurbitadienol with the recombinant host cell, wherein the recombinant host cell comprises a gene encoding cytochrome P450. In some embodiments, the contacting results in production of 11-hydroxy cucurbitadienol. In some embodiments, the 11-hydroxy cucurbitadienol is expressed in cells comprising a gene encoding CYP87D18 or SgCPR protein. In some embodiments, CYP87D18 or SgCPR comprises a sequence set forth in SEQ ID NO: 315, 872 or 874. In some embodiments, the CYP87D18 or SgCPR is encoded by SEQ ID NO: 316, 871 or 873. In some embodiments, the cucurbitadienol is also produced by the recombinant host cell. In some embodiments, the gene encoding cytochrome P450 comprises a nucleic acid sequence having at least, 70%, 80%, 85%, 90%, 95%, 98%, 99%, 100%, or a range between any two of these numbers, sequence identity to any one of SEQ ID Nos: 31-48, 316, 431, 871, 873, 875, 877, 879, 881, 883, 885, 887, and 891. In some embodiments, the cytochrome P450 comprises an amino acid sequence having at least, 70%, 80%, 85%, 90%, 95%, 98%, 99%, 100%, or a range between any two of these numbers, sequence identity to SEQ ID NO: 20 or 49. In some embodiments, the monk fruit extract comprises 2, 3-oxidosqualene. In some embodiments, the method further comprises contacting 2, 3-oxidosqualene of the monk fruit extract with the recombinant host cell, wherein the recombinant host cell comprises a seventh gene encoding cucurbitadienol synthase. In some embodiments, he cucurbitadienol synthase comprises an amino acid sequence having at least, 70%, 80%, 85%, 90%, 95%, 98%, 99%, 100%, or a range between any two of these numbers, sequence identity to SEQ ID NO: 70-73, 75-77, 319, 321, 323, 325, 327-333, 420, 422, 424, 426, 446, 902, 904 or 906. In some embodiments, the cucurbitadienol synthase is encoded by a sequence having at least, 70%, 80%, 85%, 90%, 95%, 98%, 99%, 100%, or a range between any two of these numbers, sequence identity to SEQ ID NO: 74, 320, 322, 324, 326, 328, 418, 421, 423, 425, 427, 897, 899, 901, 903, or 905. In some embodiments, the monk fruit extract comprises mogroside intermediates such as Mogroside V, Siamenoside I, Mogroside $IV_E$, Iso-mogroside V, Mogroside $III_E$, 11-Deoxy-mogroside V. 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside IIE, Mogroside $III_{A2}$, and Mogroside III. In some embodiments, the method further comprises contacting a mogroside intermediate with the recombinant host cell, wherein the recombinant host cell comprises a seventh gene encoding cucurbitadienol synthase. In some embodiments, he cucurbitadienol synthase comprises an amino acid sequence having at least, 70%, 80%, 85%, 90%, 95%, 98%, 99%, 100%, or a range between any two of these numbers, sequence identity to SEQ ID NO: 70-73, 75-77, 319, 321, 323, 325, 327-333, 420, 422, 424, 426, 446, 902, 904, or 906. In some embodiments, the cucurbitadienol synthase is encoded by a sequence having at least, 70%, 80%, 85%, 90%, 95%, 98%, 99%, 100%, or a range between any two of these numbers, sequence identity to SEQ ID NO: 74, 320, 322, 324, 326, 328, 418, 421, 423, 425, 427, 897, 899, 901, 903, or 905. In some embodiments, the contacting results in production of cucurbitadienol. In some embodiments, the 2,3-oxidosqualene and diepoxysqualene is also produced by the recombinant host cell. In some embodiments, the 2, 3-oxidosqualene or diepoxysqualene is produced by an enzyme comprising a sequence having at least, 70%, 80%, 85%, 90%, 95%, 98%, 99%, 100%, or a range between any two of these numbers, sequence identity to SEQ ID NO: 898 or 900, or comprising a sequence set forth in SEQ ID NO: 898 or 900. In some embodiments, the 2,3-oxidosqualene or diepoxysqualene is produced by an enzyme encoded by a nucleic acid sequence having at least, 70%, 80%, 85%, 90%, 95%, 98%, 99%, 100%, or a range between any two of these numbers, sequence identity to SEQ ID NO: 897 or 899; or encoded by a nucleic acid set forth in SEQ ID NO: 897 or 899.

In some embodiments, the cucurbitadienol synthase comprises an amino acid sequence having at least, 70%, 80%, 85%, 90%, 95%, 98%, 99%, 100%, or a range between any two of these numbers, sequence identity to any one of SEQ ID NOs: 70-73, 75-77, 319, 321, 323, 325, 327-333, 420, 422, 424, 426, 446, 902, 904, and 906. In some embodiments, the cucurbitadienol synthase is a cucurbitadienol synthase from *C pepo, S grosvenorii, C sativus, C melo, C moschata*, or *C maxim*. In some embodiments, the cucurbitadienol synthase is encoded by a gene comprising a nucleic acid sequence having at least, 70%, 80%, 85%, 90%, 95%, 98%. 99%, 100%, or a range between any two of these numbers, sequence identity to any one of SEQ ID NOs: 74, 320, 322, 324, 326, 328, 418, 421, 423, 425, 427, 897, 899, 901, 903, and 905, or comprising a nucleic acid sequence set forth in any one of SEQ ID NOs: 74, 320, 322, 324, 326, 328, 418, 421, 423, 425, 427, 897, 899, 901, 903 and 905. In some embodiments, 11-OH cucurbitadienol is produced by the cell. In some embodiments, 11-OH cucurbitadienol is expressed in cells comprising a gene encoding CYP87D18 or SgCPR. In some embodiments, CYP87D18 or SgCPR comprises a sequence having at least, 70%, 80%, 85%, 90%, 95%, 98%, 99%, 100%, or a range between any two of these numbers, sequence identity to SEQ ID NO: 315, 872, or 874, or a sequence set forth in SEQ ID NO: 315, 872 or 874. In some embodiments, the CYP87D18 or SgCPR is encoded by a sequence having at least, 70%, 80%, 85%, 90%, 95%, 98%, 99%, 100%, or a range between any two of these numbers, sequence identity to SEQ ID NO: 316, 871 or 873, or a sequence set forth in SEQ ID NO: 316, 871 or 873. In some embodiments, the monk fruit extract comprises squalene. In some embodiments, the 2,3-oxidosqualene or diepoxysqualene is produced by an enzyme comprising a sequence having at least 70%, 80%, 85%, 90%, 95%, 98%, 99%, or more sequence identity to SEQ ID NO: 898 or 900, or a sequence set forth in SEQ ID NO: 898 or 900. In some embodiments, the 2, 3-oxidosqualene or diepoxysqualene is produced by an enzyme encoded by a nucleic acid sequence having at least, 70%, 80%, 85%, 90%, 95%, 98%, 99%, 100%, or a range between any two of these numbers, sequence identity to SEQ ID NO; 897 or 899, or a sequence set forth in SEQ ID NO: 897 or 899. In some embodiments, the method further comprises contacting squalene with the recombinant host cell, wherein the recombinant host cell comprises an eighth gene encoding a squalene epoxidase. In some embodiments, the contacting results in production of 2,3-oxidosqualene. In some embodiments, the squalene is also produced by the recombinant host cell. In some embodiments, the squalene epoxidase comprises an amino acid sequence having at least, 70%, 80%, 85%, 90%, 95%, 98%, 99%, 100%, or a range between any two of these numbers, sequence identity to any one of SEQ ID NOs: 50-56, 60, 61, 334 or 335. In some embodiments, squalene epoxide is encoded by a nucleic acid sequence set forth in SEQ ID NO: 335. In some embodiments, the monk fruit extract comprises farnesyl pyrophosphate. In some embodiments, the method further comprises contacting farnesyl pyrophosphate with the recombinant host cell, wherein the recombinant host cell comprises a ninth gene encoding a squalene synthase. In some embodiments, the contacting results in production of squalene. In some embodiments, the farnesyl pyrophosphate is also produced by the recombinant host cell. In some embodiments, the squalene synthase comprises an amino acid sequence having at least 70%, at least 80%, at least 90%, at least 95%, at least 98%, at least 99%, or more of sequence identity to any one of SEQ ID NO: 69 and 336. In some embodiments, the squalene synthase is encoded by a sequence comprising the nucleic acid sequence set forth in SEQ ID NO: 337. In some embodiments, the monk fruit extract comprises geranyl-PP. In some embodiments, the method further comprises contacting geranyl-PP with the recombinant host cell, wherein the recombinant host cell comprises a tenth gene encoding farnesyl-PP synthase. In some embodiments, the contacting results in production of farnesyl-PP. In some embodiments, the geranyl-PP is also produced by the recombinant host cell. In some embodiments, the farnesyl-PP synthase comprises an amino acid sequence having at least 70%, at least 80%, at least 90%, at least 95%, at least 98%, at least 99%, or more sequence identity to SEQ ID NO: 338. In some embodiments, the farnesyl-PP synthase is encoded by a nucleic acid sequence set forth in SEQ ID NO: 339. In some embodiments, one or more of the first, second, third, fourth, fifth, sixth, seventh, eighth, ninth, and tenth gene is operably linked to a heterologous promoter. In some embodiments, the heterologous promoter is a CMV, EF1a, SV40, PGK1, human beta actin, CAG, GAL1, GAL10, TEF1, GDS, ADH1, CaMV35S, Ubi, T7, T7lac, Sp6, araBAD, trp, lac, Ptac, pL promoter, or a combination thereof. In some embodiments, the promoter is an inducible, repressible, or constitutive promoter. In some embodiments, production of one or more of pyruvate, acetyl-CoA, citrate, and TCA cycle intermediates have been upregulated in the recombinant host cell. In some embodiments, cytosolic localization has been upregulated in the recombinant host cell. In some embodiments, one or more of the first, second third, fourth, fifth, sixth, seventh, eighth, ninth, and tenth gene comprises at least one sequence encoding a 2A self-cleaving peptide. In some embodiments, the recombinant host cell is a plant, bivalve, fish, fungus, bacteria or mammalian cell. In some embodiments, the plant is selected from *Siraitia, Momordica, Gynostemma, Cucurbita, Cucumis, Arabidopsis, Artemisia, Stevia, Panax, Withania, Euphorbia, Medicago, Chlorophytum, Eleutherococcus, Aralia, Morus, Medicago, Betula, Astragalus, Jatropha, Camellia, Hypholoma, Aspergillus, Solanum, Huperzia, Pseudostellaria, Corchorus, Hedera, Marchantia*, and *Morus*. In some embodiments, the fungus is selected from *Trichophyton, Sanghuangporus, Taiwanofungus, Moniliophthora, Marssonina, Diplodia, Lentinula, Xanthophyllomyces, Pochonia, Colletotrichum, Diaporthe, Histoplasma, Coccidioides, Histoplasma, Sanghuangporus, Aurcobasidium, Pochonia, Penicillium, Sporothrix, Metarhizium, Aspergillus, Yarrowia*, and *Lipomyces*. In some embodiments, the fungus is *Aspergillus nidulans, Yarrowia lipolytica*, or *Rhodosporin toruloides*. In some embodiments, the recombinant host cell is a yeast cell. In some embodiments, the yeast is selected from *Candida, Sacccharaomyces, Saccharomycotina, Taphrinomycotina, Schizosaccharomyces, Komagataella, Basidiomycota, Agaricomycotina, Tremellomycetes, Pucciniomycotina, Aurcobasidium, Coniochacta, Rhodosporidium,* and *Microboryomycetes*. In some embodiments, the bacteria is selected from the group consisting of *Frankia, Actinobac-* teria, *Streptomyces*, and *Enterococcus*. In some embodiments, the bacteria is *Enterococcus faecalis*. In some embodiments, one or more of the first, second third, fourth, fifth, sixth, seventh, eighth, ninth, and tenth gene has been codon optimized for expression in a bacterial, mammalian, plant, fungal or insect cell. In some embodiments, one or more of the first, second third, fourth, fifth, sixth, seventh, eighth, ninth, and tenth genes comprises a functional mutation to increased activity of the encoded enzyme. In some embodiments, cultivating the recombinant host cell comprises monitoring the cultivating for pH, dissolved oxygen level, nitrogen level, or a combination thereof of the cultivating conditions. In some embodiments, the method comprises isolating Compound 1. In some embodiments, isolating Compound 1 comprises lysing the recombinant host cell. In some embodiments, isolating Compound 1 comprises isolating Compound 1 from the culture medium. In some embodiments, the method further comprises purifying Compound 1. In some embodiments, purifying Compound 1 comprises HPLC, solid phase extraction or a combination thereof. In some embodiments, the purifying further comprises harvesting the recombinant cells, saving the supernatant and lysing the cells. In some embodiments, the lysing comprises subjecting the cells to shear force or detergent washes thereby obtaining a lysate. In some embodiments, the shear force is from a sonication method, french pressurized cells, or beads. In some embodiments, the lysate is subjected to filtering and purification steps. In some embodiments, the lysate is filtered and purified by solid phase extraction. In some embodiments, the method further comprises second or third additions of monk fruit extract to the growth media of the recombinant host cells. Additionally the method can be performed by contacting the monk fruit extract with the recombinant cell lysate, wherein the recombinant cell lysate comprises the expressed enzymes listed herein.

In general, compounds as disclosed and described herein, individually or in combination, can be provided in a composition, such as, e.g., an ingestible composition. In one embodiment, compounds as disclosed and described herein, individually or in combination, can provide a sweet flavor to an ingestible composition. In other embodiments, the compounds disclosed and described herein, individually or in combination, can act as a sweet flavor enhancer to enhance the sweetness of another sweetener. In other embodiments, the compounds disclosed herein impart a more sugar-like temporal profile and/or flavor profile to a sweetener composition by combining one or more of the compounds as disclosed and described herein with one or more other sweeteners in the sweetener composition. In another embodiment, compounds as disclosed and described herein, individually or in combination, can increase or enhance the sweet taste of a composition by contacting the composition thereof with the compounds as disclosed and described herein to form a modified composition. In another embodiment, compounds as disclosed and described herein, individually or in combination, can be in a composition that modulates the sweet receptors and/or their ligands expressed in the body other than in the taste buds.

As used herein, an "ingestible composition" includes any composition that, either alone or together with another substance, is suitable to be taken by mouth whether intended for consumption or not. The ingestible composition includes both "food or beverage products" and "non-edible products". By "Food or beverage products", it is meant any edible product intended for consumption by humans or animals, including solids, semi-solids, or liquids (e.g., beverages) and includes functional food products (e.g., any fresh or processed food claimed to have a health-promoting and/or disease-preventing properties beyond the basic nutritional function of supplying nutrients). The term "non-food or beverage products" or "noncomestible composition" includes any product or composition that can be taken into the mouth by humans or animals for purposes other than consumption or as food or beverage. For example, the non-food or beverage product or noncomestible composition includes supplements, nutraceuticals, pharmaceutical and over the counter medications, oral care products such as dentifrices and mouthwashes, and chewing gum.

In some aspects, the compositions disclosed herein further comprise at least one additional sweetener and/or sweet modifier. The at least one additional sweetener and/or sweet modifier may be an artificial sweetener and/or sweet modifier, or, alternatively, a natural sweetener and/or sweet modifier. The at least one additional sweetener and/or sweet modifier may be selected from the group consisting of: abiziasaponin, abrusosides, in particular abrusoside A, abrusoside B, abrusoside C, abrusoside D, acesulfame potassium, advantame, albiziasaponin, alitame, aspartame, super-aspartame, bayunosides, in particular bayunoside 1, bayunoside 2, brazzein, bryoside, bryonoside, bryonodulcoside, carnosifloside, carrelame, curculin, cyanin, chlorogenic acid, cyclamates and its salts, cyclocaryoside I, dihydroquercetin-3-acetate, dihydroflavenol, dulcoside, gaudichaudioside, glycyrrhizin, glycyrrhetin acid, gypenoside, hematoxylin, isomogrosides, in particular iso-mogroside V, lugduname, magap, mabinlins, miraculin, mogrosides (lo han guo), in particular mogroside IV and mogroside V, monatin and its derivatives, monellin, mukuroziosides, naringin dihydrochalcone (NarDHC), neohesperidin dihydrochalcone (NHDC), neotame, osladin, pentadin, periandrin I-V, perillartine, D-phenylalanine, phlomisosides, in particular phlomisoside 1, phlomisoside 2, phlomisoside 3, phlomisoside 4, phloridzin, phyllodulcin, polpodiosides, polypodoside A, pterocaryosides, rebaudiosides, in particular rebaudioside A, rebaudioside B, rebaudioside C, rebaudioside D, rebaudioside E, rebaudioside F, rebaudioside G, rebaudioside H, rebaudioside M, rubusosides, saccharin and its salts and derivatives, scandenoside, selligueanin A, siamenosides, in particular siamenoside I, *stevia*, steviolbioside, stevioside and other steviol glycosides, strogines, in particular strogin 1, strogin 2, strogin 4, suavioside A, suavioside B, suavioside G, suavioside H, suavioside I, suavioside J, sucralose, sucronate, sucrooctate, talin, telosmoside A15, thaumatin, in particular thaumatin I and II, trans-anethol, trans-cinnamaldehyde, trilobatin, D-tryptophane, erythritol, galactitol, hydrogenated starch syrups including maltitol and sorbitol syrups, inositols, isomalt, lactitol, maltitol, mannitol, xylitol, arabinose, dextrin, dextrose, fructose, high fructose corn syrup, fructooligosaccharides, fructooligosaccharide syrups, galactose, galactooligosaccharides, glucose, glucose and (hydrogenated) starch syrups/hydrolysates, isomaltulose, lactose, hydrolysed lactose, maltose, mannose, rhamnose, ribose, sucrose, tagatose, trehalose and xylose.

Compositions Comprising Mogroside Compounds

Figure 43:
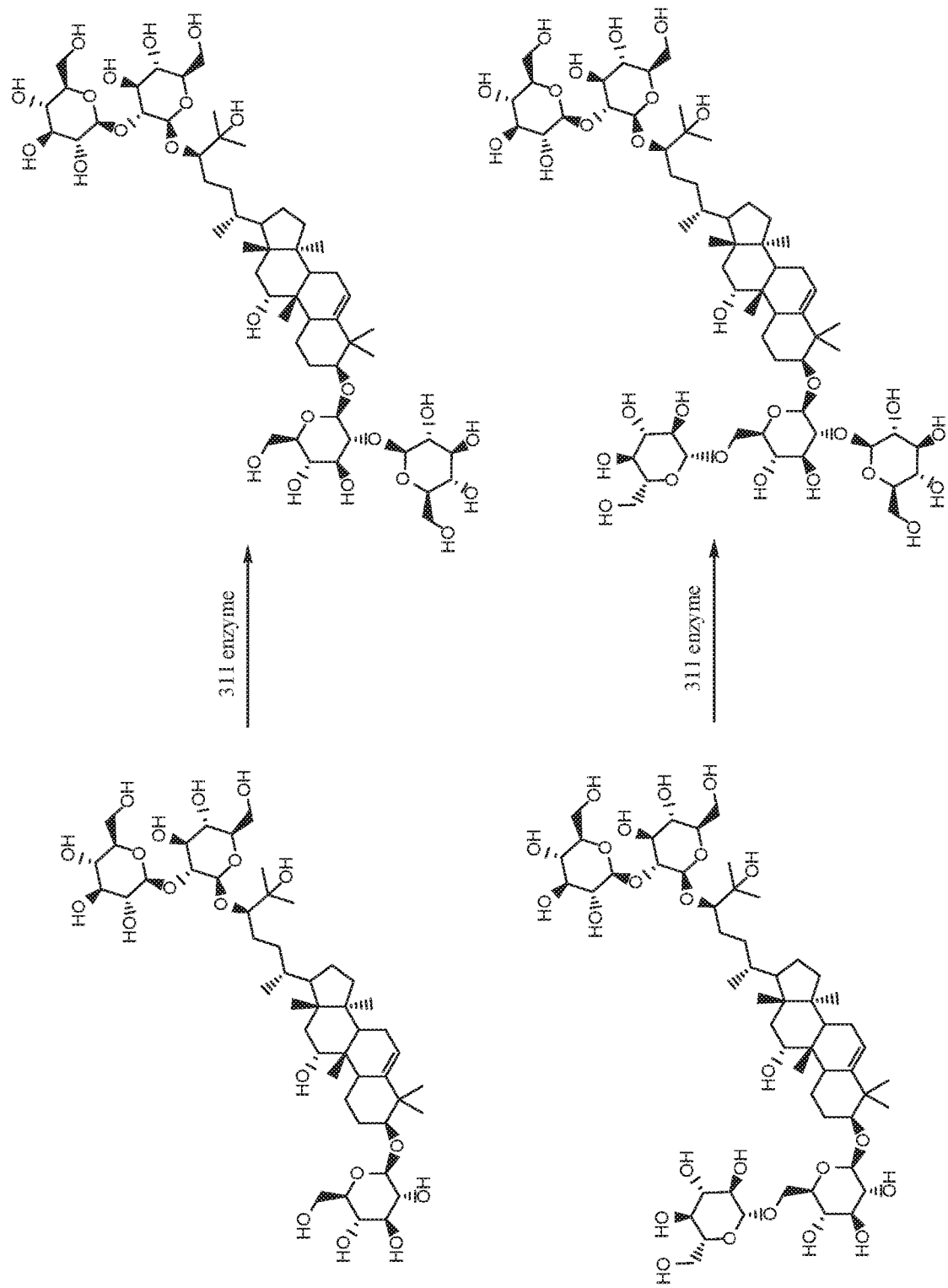
FIG. 43 shows enzymatic reactions catalyzed by the 311 enzyme (UDP-glycosyltransferases.
Figure 43:
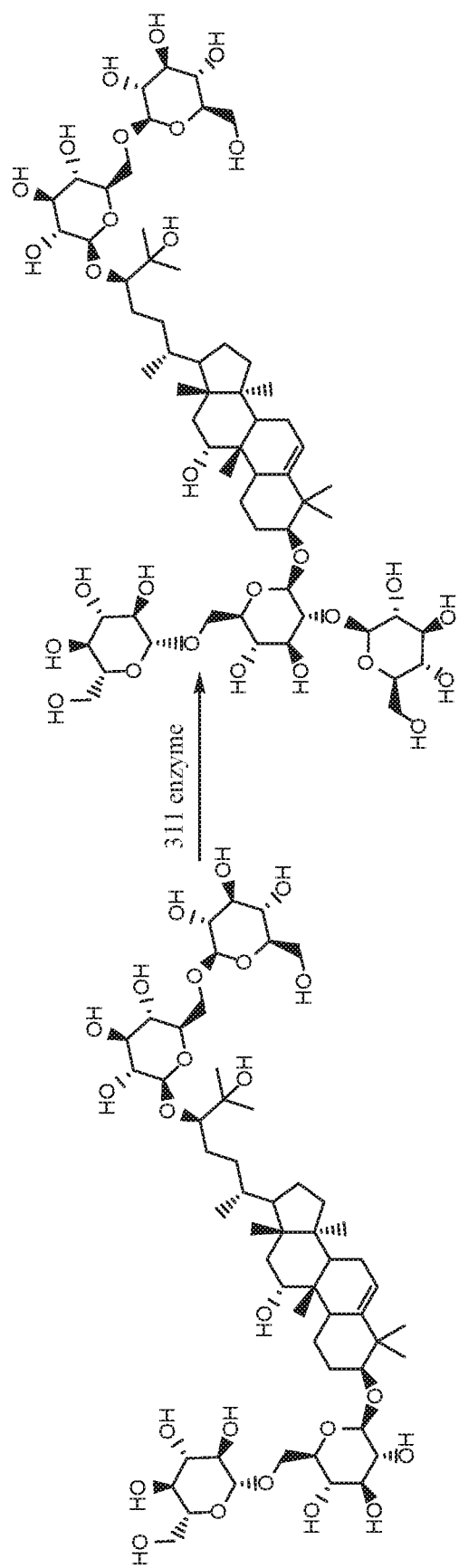

Also disclosed herein include compositions, e.g., ingestible compositions, comprising one or more of the mogroside compounds disclosed herein, including but not limited to Compound 1 and the compounds shown in FIG. 43. In some embodiments, an ingestible composition can be a beverage. For example, the beverage can be selected from the group consisting of enhanced sparkling beverages, colas, lemon-lime flavored sparkling beverages, orange flavored sparkling beverages, grape flavored sparkling beverages, strawberry flavored sparkling beverages, pineapple flavored sparkling beverages, ginger-ales, root beers, fruit juices, fruit-flavored juices, juice drinks, nectars, vegetable juices, vegetable-flavored juices, sports drinks, energy drinks, enhanced water drinks, enhanced water with vitamins, near water drinks, coconut waters, tea type drinks, coffees, cocoa drinks, beverages containing milk components, beverages containing cereal extracts and smoothies. In some embodiments, the beverage can be a soft drink.

An "ingestibly acceptable ingredient" is a substance that is suitable to be taken by mouth and can be combined with a compound described herein to form an ingestible composition. The ingestibly acceptable ingredient may be in any form depending on the intended use of a product, e.g., solid, semi-solid, liquid, paste, gel, lotion, cream, foamy material, suspension, solution, or any combinations thereof (such as a liquid containing solid contents). The ingestibly acceptable ingredient may be artificial or natural. Ingestibly acceptable ingredients includes many common food ingredients, such as water at neutral, acidic, or basic pH, fruit or vegetable juices, vinegar, marinades, beer, wine, natural water/fat emulsions such as milk or condensed milk, edible oils and shortenings, fatty acids and their alkyl esters, low molecular weight oligomers of propylene glycol, glyceryl esters of fatty acids, and dispersions or emulsions of such hydrophobic substances in aqueous media, salts such as sodium chloride, wheat flours, solvents such as ethanol, solid edible diluents such as vegetable powders or flours, or other liquid vehicles; dispersion or suspension aids; surface active agents; isotonic agents; thickening or emulsifying agents, preservatives; solid binders; lubricants and the like.

Additional ingestibly acceptable ingredients include acids, including but are not limited to, citric acid, phosphoric acid, ascorbic acid, sodium acid sulfate, lactic acid, or tartaric acid; bitter ingredients, including, for example caffeine, quinine, green tea, catechins, polyphenols, green robusta coffee extract, green coffee extract, whey protein isolate, or potassium chloride; coloring agents, including, for example caramel color, Red #40, Yellow #5, Yellow #6, Blue #1, Red #3, purple carrot, black carrot juice, purple sweet potato, vegetable juice, fruit juice, beta carotene, turmeric curcumin, or titanium dioxide; preservatives, including, for example sodium benzoate, potassium benzoate, potassium sorbate, sodium metabisulfate, sorbic acid, or benzoic acid; antioxidants including, for example ascorbic acid, calcium disodium EDTA, alpha tocopherols, mixed tocopherols, rosemary extract, grape seed extract, resveratrol, or sodium hexametaphosphate; vitamins or functional ingredients including, for example resveratrol, Co-Q10, omega 3 fatty acids, theanine, choline chloride (citocoline), fibersol, inulin (chicory root), taurine, *Panax ginseng* extract, guanana extract, ginger extract, L-phenylalanine, L-carnitine, L-tartrate, D-glucoronolactone, inositol, bioflavonoids, *Echinacea, Ginko biloba*, yerba mate, flax seed oil, *Garcinia cambogia* rind extract, white tea extract, ribose, milk thistle extract, grape seed extract, pyrodixine HCl (vitamin B6), cyanoobalamin (vitamin B12), niacinamide (vitamin B3), biotin, calcium lactate, calcium pantothenate (pantothenic acid), calcium phosphate, calcium carbonate, chromium chloride, chromium polynicotinate, cupric sulfate, folic acid, ferric pyrophosphate, iron, magnesium lactate, magnesium carbonate, magnesium sulfate, monopotassium phosphate, monosodium phosphate, phosphorus, potassium iodide, potassium phosphate, riboflavin, sodium sulfate, sodium gluconate, sodium polyphosphate, sodium bicarbonate, thiamine mononitrate, vitamin D3, vitamin A palmitate, zinc gluconate, zinc lactate, or zinc sulphate; clouding agents, including, for example ester gun, brominated vegetable oil (BVO), or sucrose acetate isobutyrate (SAIB); buffers, including, for example sodium citrate, potassium citrate, or salt; flavors, including, for example propylene glycol, ethyl alcohol, glycerine, gum Arabic (gum acacia), maltodextrin, modified corn starch, dextrose, natural flavor, natural flavor with other natural flavors (natural flavor WONF), natural and artificial flavors, artificial flavor, silicon dioxide, magnesium carbonate, or tricalcium phosphate; and stabilizers, including, for example pectin, xanthan gum, carboxylmethylcellulose (CMC), polysorbate 60, polysorbate 80, medium chain triglycerides, cellulose gel, cellulose gum, sodium caseinate, modified food starch, gum Arabic (gum acacia), or carrageenan.

EXAMPLES

Some aspects of the embodiments discussed above are disclosed in further detail in the following examples, which are not in any way intended to limit the scope of the present disclosure.

Example 1: Production of Siamenoside I

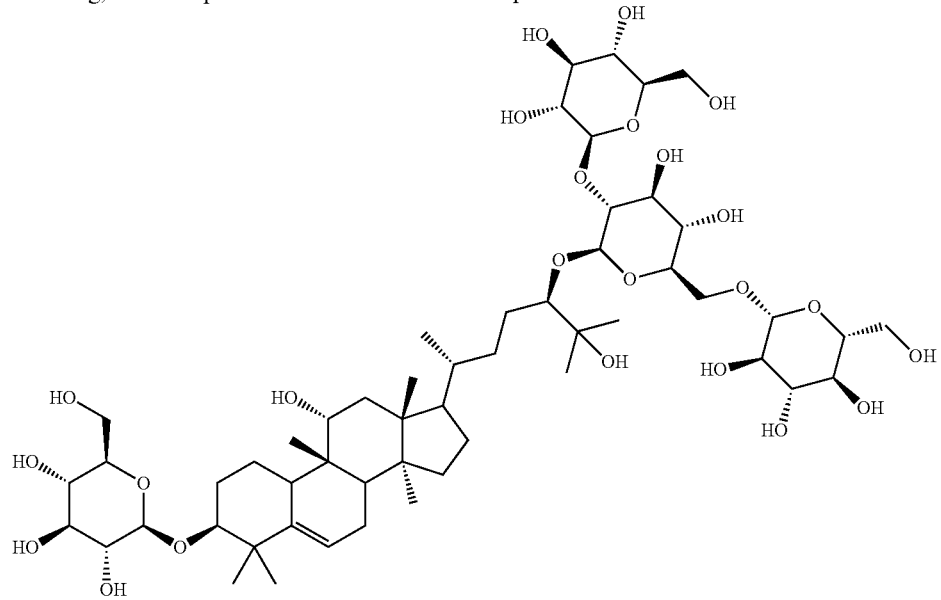

As disclosed herein, siamenoside I can be an intermediate mogroside compound for the production of Compound 1 disclosed herein. For example, siamenoside I may be hydrolyzed to produce mogroside IIIE which can then be used to produce Compound 1. For example, a method for producing siamenoside I can comprise: contacting mogrol with a recombinant host cell expressing one or more of UDP glycosyltransferases, CGTases, glycotransferases, dextransucrases, cellulases, β-glucosidases, amylases, transglucosidases, pectinases, and dextranases. For example, a recombinant cell expressing pectinase from *Aspergillus aculeatus* can be used.

As another non-limiting example, the method for producing siamenoside I can comprise: contacting one or more of Mogroside V, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside IIE, Mogroside IIIA2, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a pectinase from *Aspergillus aculeatus* can be used.

Example 2: Production of Mogroside IV$_E$

As disclosed herein, Mogroside IV$_E$ can be an intermediate mogroside compound for the production of Compound 1 disclosed herein. For example, Mogroside IV$_E$ from mogroside V can then be used to produce Compound 1. For example, a method for producing Mogroside IV$_E$ can comprise: contacting mogroside V with a recombinant host cell expressing one or more of UDP glycosyltransferases, CGTases, glycotransferases, dextransucrases, cellulases, β-glucosidases, amylases, transglucosidases, pectinases, and dextranases. As another example the recombinant cell can comprise a gene encoding pectinase. The pectinase can be encoded by a gene from *Aspergillus aculeatus*.

As another example, the method for producing Mogroside IV$_E$ can comprise: contacting one or more of Mogroside V, Siamenoside I, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a pectinase from *Aspergillus aculeatus* can be used.

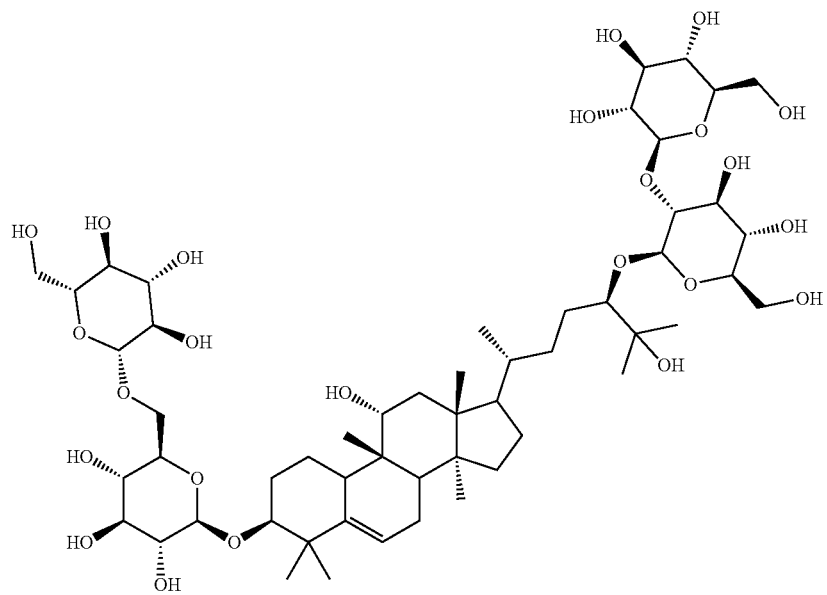 [SMILES: C[C@H](CC[C@@H](O[C@@H]1O[C@H](CO)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO[C@@H]6O[C@H](CO)[C@@H](O)[C@H](O)[C@H]6O)[C@@H](O)[C@H](O)[C@H]5O)C4(C)C)[C@]3(C)[C@H](O)C[C@]12C]

Example 3: Production of Mogroside III$_E$

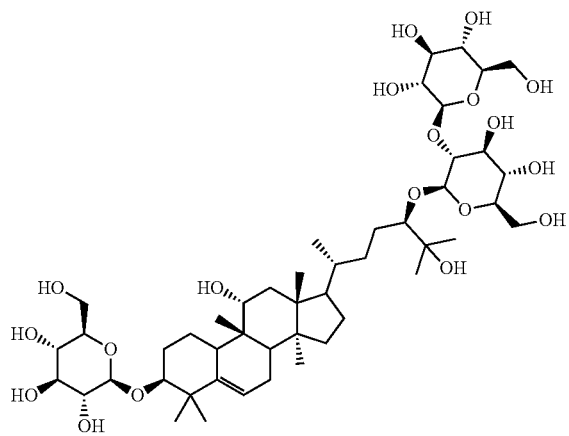 [SMILES: C[C@H](CC[C@@H](O[C@@H]1O[C@H](CO)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

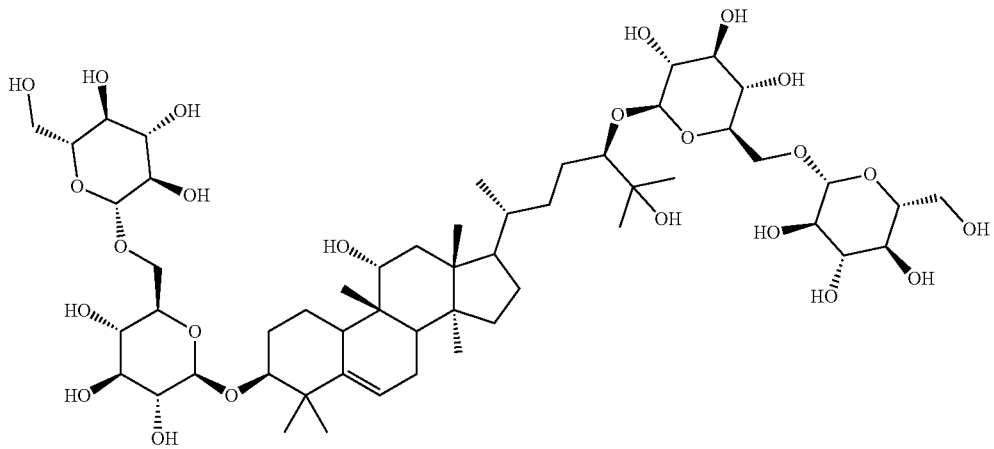 [SMILES: C[C@H](CC[C@@H](O[C@@H]1O[C@H](CO[C@@H]2O[C@H](CO)[C@@H](O)[C@H](O)[C@H]2O)[C@@H](O)[C@H](O)[C@H]1O)C(C)(C)O)C1CC[C@@]2(C)C3CC=C4C(CC[C@H](O[C@@H]5O[C@H](CO[C@@H]6O[C@H](CO)[C@@H](O)[C@H](O)[C@H]6O)[C@@H](O)[C@H](O)[C@H]5O)C4(C)C)[C@]3(C)[C@H](O)C[C@]12C]

As disclosed herein, Mogroside III$_E$ can be an intermediate mogroside compound for the production of Compound 1 disclosed herein. For example, Mogroside II$_A$ may be glycosylated to produce mogroside IIIE which can then be used to produce Compound 1.

As another example, the method for producing Mogroside III$_E$ can comprise: contacting one or more of Mogroside V, Mogroside II$_A$, Siamenoside I, Mogroside IV$_E$, Iso-mogroside V, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a pectinase from *Aspergillus aculeatus* can be encoded by a gene within the recombinant host cell.

Example 4: Production of Mogroside IV$_A$

As disclosed herein, Mogroside IV$_A$ can be an intermediate mogroside compound for the production of Compound 1 disclosed herein. For example, Mogroside IV$_A$ from mogroside V can then be used to produce Compound 1.

For example, a method for producing Mogroside IV$_A$ can comprise: contacting Mogroside V with a recombinant host cell expressing one or more of UDP glycosyltransferases, CGTases, glycotransferases, dextransucrases, cellulases, β-glucosidases, amylases, transglucosidases, pectinases, and dextranases. The enzyme can also be a β-galactosidase from *Aspergillus oryzae*, for example.

As another example, the method for producing Mogroside IV$_A$ can comprise: contacting one or more of Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a β-galactosidase from *Aspergillus oryzae* can be used in the method.

Example 5: Production of Mogroside II$_A$

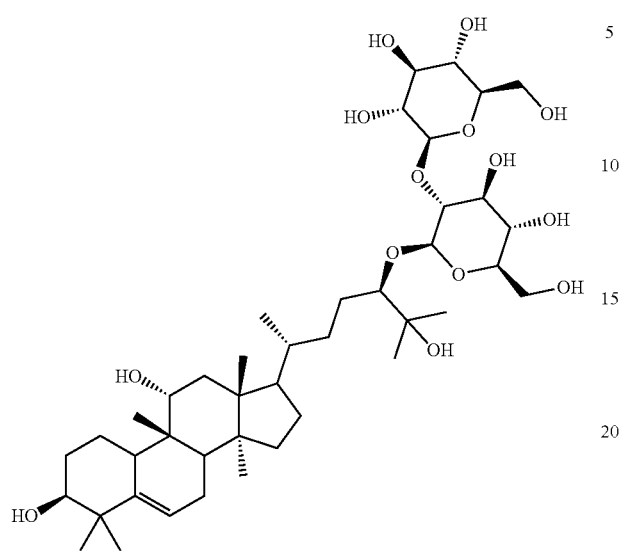

As disclosed herein, Mogroside II$_A$ can be an intermediate mogroside compound for the production of Compound 1 disclosed herein. For example, a method for producing Mogroside II$_A$ can comprise: contacting Mogroside I$_{A1}$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Mogroside II$_A$ can comprise: contacting one or more of Mogroside IA$_1$, Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a celluclast can also be used.

Example 6: Production of Mogroside III$_{A1}$ from Aromase

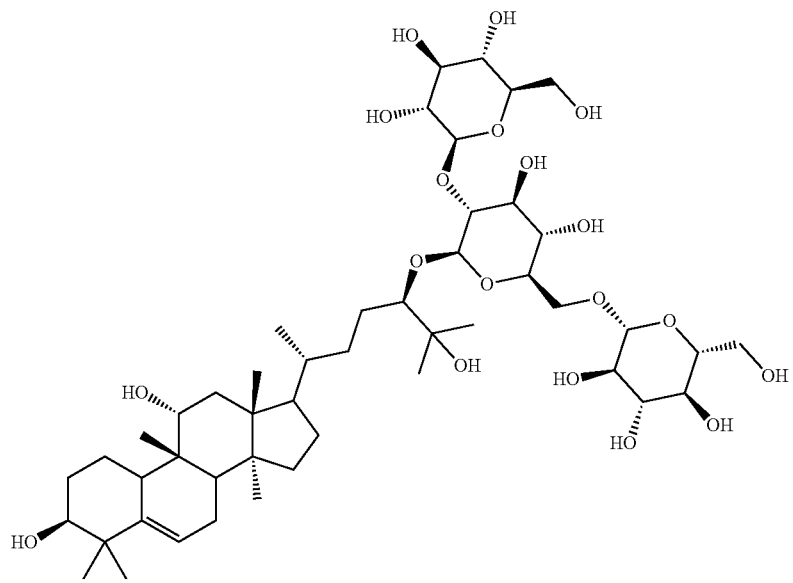 [SMILES: C[C@H](CC[C@@H](O[C@@H]1O[C@H](CO[C@@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O)C4(C)C)[C@]3(C)[C@H](O)C[C@]12C]

As disclosed herein, Mogroside III$_{A1}$ can be an intermediate mogroside compound for the production of Compound 1 disclosed herein. For example, Mogroside III$_{A1}$ can be an intermediate to produce mogroside IV$_A$ which can then be used as an intermediate to produce Compound 1. For example, a method for producing Mogroside III$_{A1}$ I can comprise contacting Siamenoside I with a recombinant host cell expressing one or more of UDP glycosyltransferases, CGTases, glycotransferases, dextransucrases, cellulases, β-glucosidases, amylases, transglucosidases, pectinases, and dextranases. The enzyme can also be Aromase, for example. As another example, the method for producing Mogroside III$_{A1}$ I can comprise: contacting one or more of Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases.

Example 8: Production of Compound 4

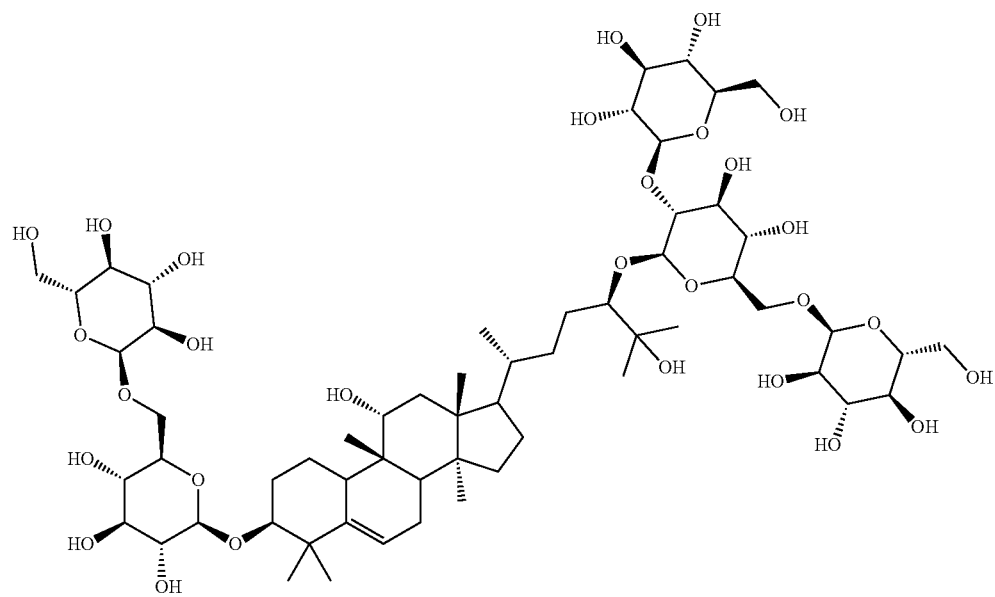 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO[C@H]6O[C@H](CO)[C@@H](O)[C@H](O)[C@H]6O)[C@@H](O)[C@H](O)[C@H]5O)C4(C)C)[C@]3(C)[C@H](O)C[C@]12C]

As disclosed herein, Compound 4 produced during the production of Compound 1 disclosed herein. For example, a method for producing Compound 4 can also lead to the production of Compound 1, the method can comprise contacting Mogroside III$_E$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 4 can comprise: contacting one or more of Mogroside V, Siamenoside I, Mogroside IVE, Iso-mogroside V, Mogroside IIIE, 11-Deoxy-mogroside V, 11-Oxo-mogroside V, Mogroside VI, Mogroside IVA, Mogroside IIA, Mogroside IIA1, Mogroside IIA2, Mogroside IA, 11-oxo-Mogroside VI, 11-oxo-Mogroside IIIE, 11-oxo-Mogroside IVE, Mogroside IE, Mogrol, 11-oxo-mogrol, Mogroside IIE, Mogroside IIIA2, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be Cyclomaltodextrin glucanotransferase from *Bacillus lichenformis* and/or Toruzyme, for example.

Example 9: Production of Compound 5

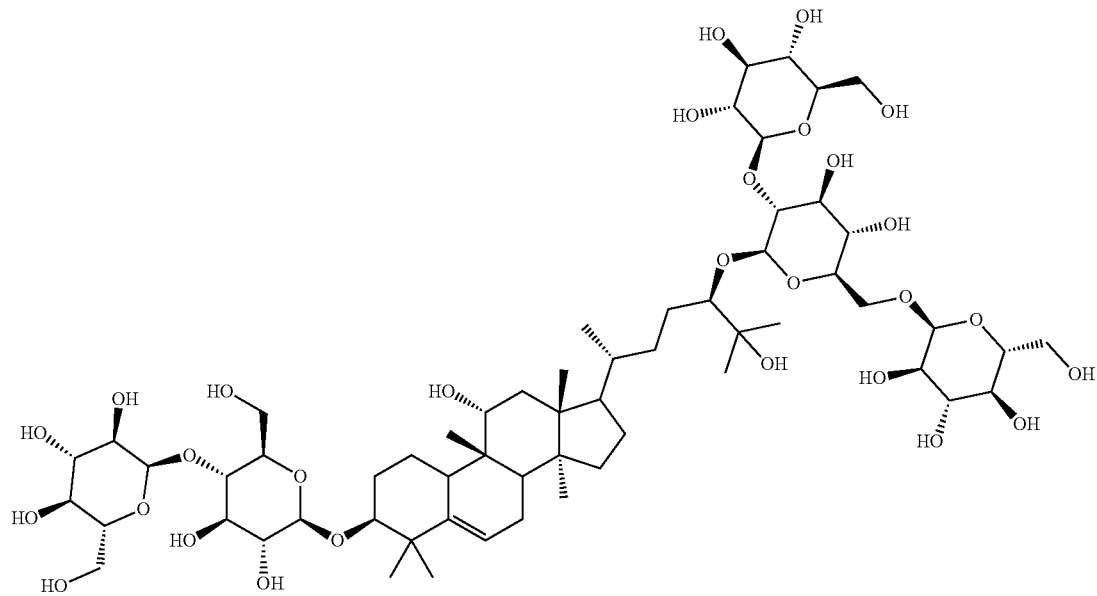 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O[C@H]6O[C@H](CO)[C@@H](O)[C@H](O)[C@H]6O)[C@H](O)[C@H]5O)C4(C)C)[C@]3(C)[C@H](O)C[C@]12C]

Compound 5 can be an intermediate mogroside compound produced during the production of Compound 1 disclosed herein. For example, a method for producing Compound 5 can also lead to the production of Compound 1, the method can comprise contacting Mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 5 can comprise: contacting one or more of Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a CGTase from *Bacillus licheniformis* or Toruzyme can be used.

Example 10: Production of Compound 6

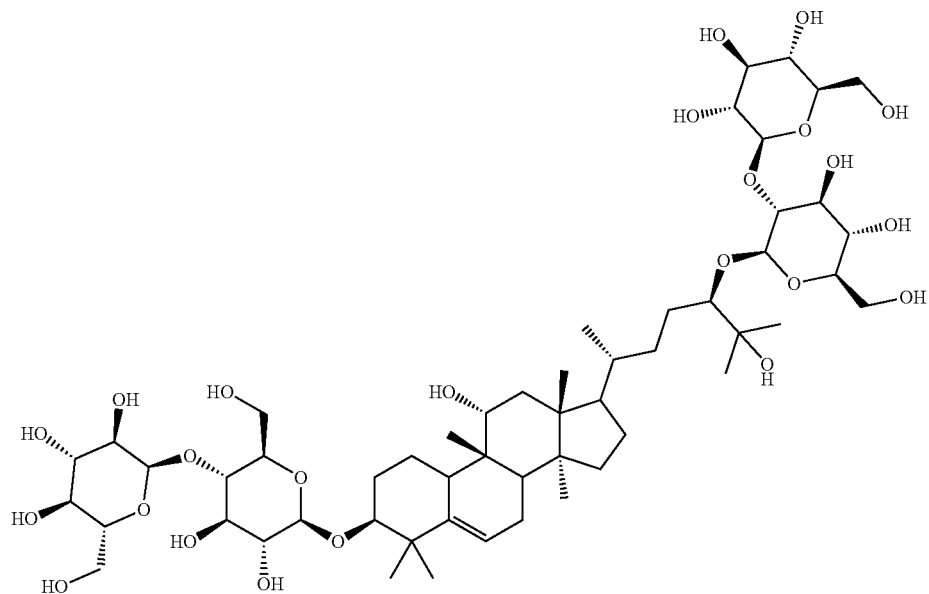 [SMILES: C[C@H](CC[C@@H](O[C@@H]1O[C@H](CO)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O[C@H]6O[C@H](CO)[C@@H](O)[C@H](O)[C@H]6O)[C@H](O)[C@H]5O)C4(C)C)[C@]3(C)[C@H](O)C[C@]12C]

As disclosed herein, Compound 6 can be an intermediate mogroside compound produced during the production of Compound 1 disclosed herein. For example, a method for producing Compound 6 can also lead to the production of Compound 1, the method can comprise contacting Mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 6 can comprise: contacting one or more of Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a CGTase from *Bacillus licheniformis* or Toruzyme can be used.

Example 11: Production of Compound 7

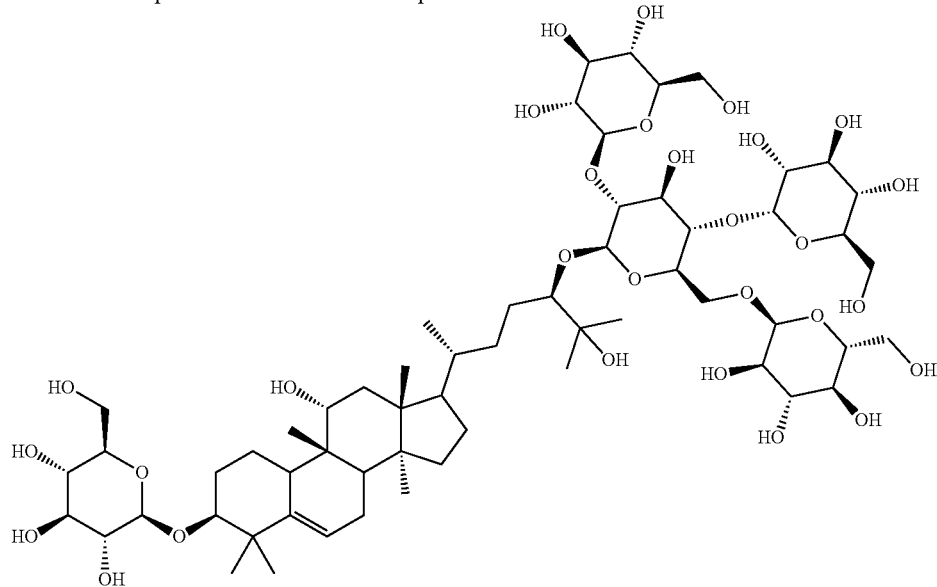 [SMILES: C[C@H](CC[C@@H](O[C@@H]1O[C@H](CO[C@H]2O[C@H](CO)[C@@H](O)[C@H](O)[C@H]2O)[C@@H](O[C@H]2O[C@H](CO)[C@@H](O)[C@H](O)[C@H]2O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

As disclosed herein, Compound 7 can be an intermediate mogroside compound produced during the production of Compound 1 disclosed herein. For example, a method for producing Compound 7 can also lead to the production of Compound 1, the method can comprise contacting Mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 7 can comprise: contacting one or more of Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a CGTase from *Bacillus licheniformis* or Toruzyme can be used.

Example 12: Production of Compound 8

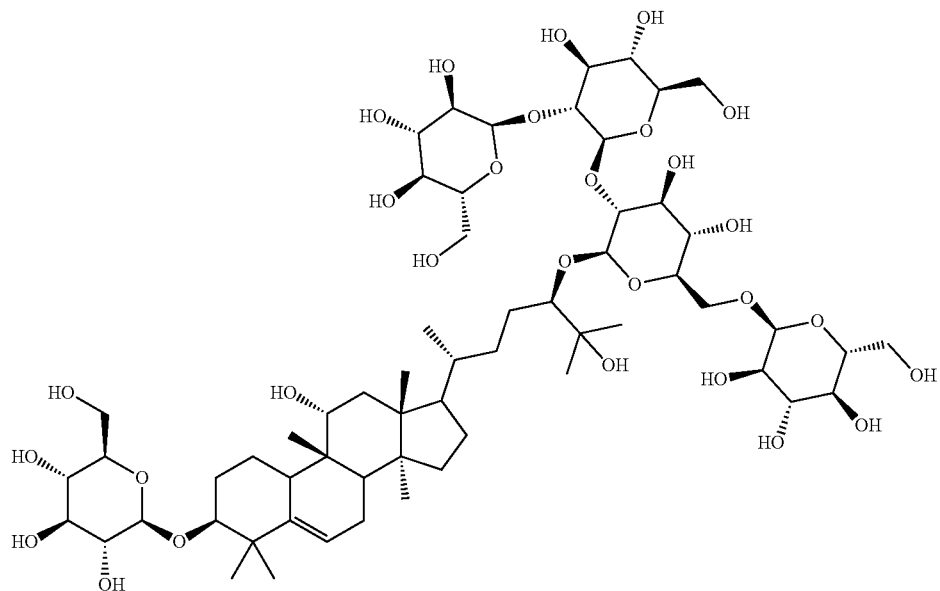 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O[C@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

As disclosed herein, Compound 8 can be an intermediate mogroside compound produced during the production of Compound 1 disclosed herein. For example, a method for producing Compound 8 can also lead to the production of Compound 1, the method can comprise contacting Mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 8 can comprise: contacting one or more of Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a CGTase from *Bacillus licheniformis* or Toruzyme can be used.

Example 13: Production of Compound 9

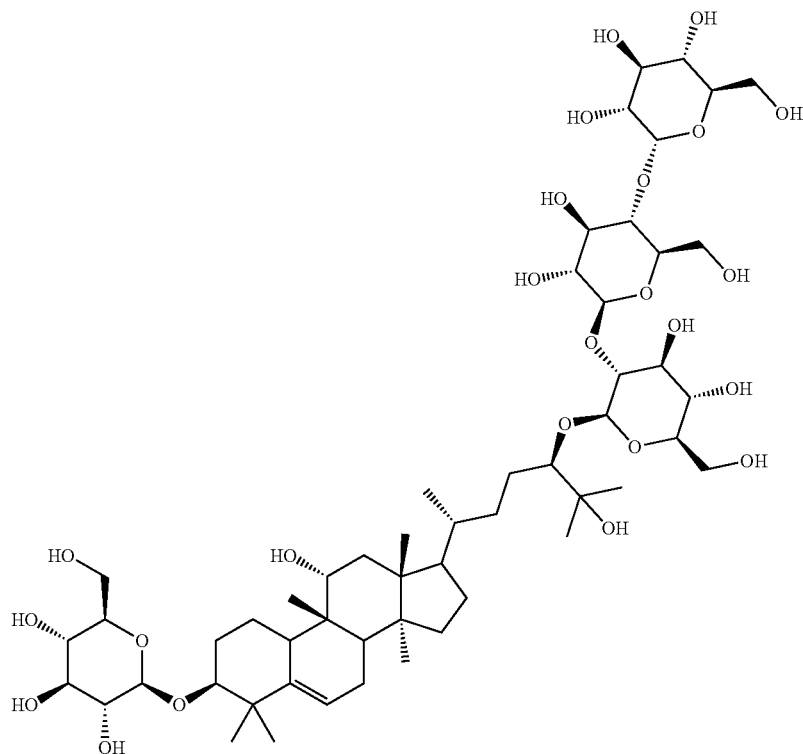 [SMILES: C[C@H](CC[C@@H](O[C@@H]1O[C@H](CO)[C@@H](O)[C@H](O)[C@H]1O[C@@H]1O[C@H](CO)[C@@H](O[C@H]2O[C@H](CO)[C@@H](O)[C@H](O)[C@H]2O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

As disclosed herein, Compound 9 can be an intermediate mogroside compound produced during the production of Compound 1 disclosed herein. For example, a method for producing Compound 9 can also lead to the production of Compound 1, the method can comprise contacting Mogroside IIIE with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 9 can comprise: contacting one or more of Mogroside V, Siamenoside I, Mogroside IVE, Iso-mogroside V, Mogroside IIIE, 11-Deoxy-mogroside V, 11-Oxo-mogroside V, Mogroside VI, Mogroside IVA, Mogroside IIA, Mogroside IIA1, Mogroside IIA2, Mogroside IA, 11-oxo-Mogroside VI, 11-oxo-Mogroside IIIE, 11-oxo-Mogroside IVE, Mogroside IE, Mogrol, 11-oxo-mogrol, Mogroside IIE, Mogroside IIIA2, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a CGTase from *Bacillus lichenformis* or Toruzyme can be used.

Example 14: Production of Compound 10

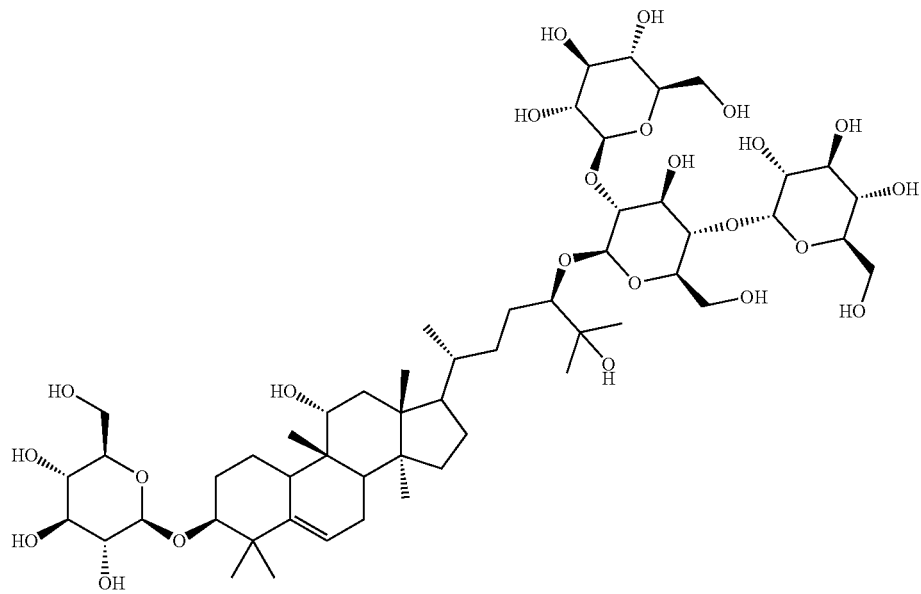 [SMILES: C[C@H](CC[C@@H](O[C@@H]1O[C@H](CO)[C@@H](O[C@H]2O[C@H](CO)[C@@H](O)[C@H](O)[C@H]2O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

As disclosed herein, Compound 10 can be an intermediate mogroside compound produced during the production of Compound 1 disclosed herein. For example, a method for producing Compound 10 can also lead to the production of Compound 1, the method can comprise contacting Mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 10 can comprise: contacting one or more of Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_4$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a CGTase from *Bacillus licheniformis* or Toruzyme can be used.

Example 15: Production of Compound 11

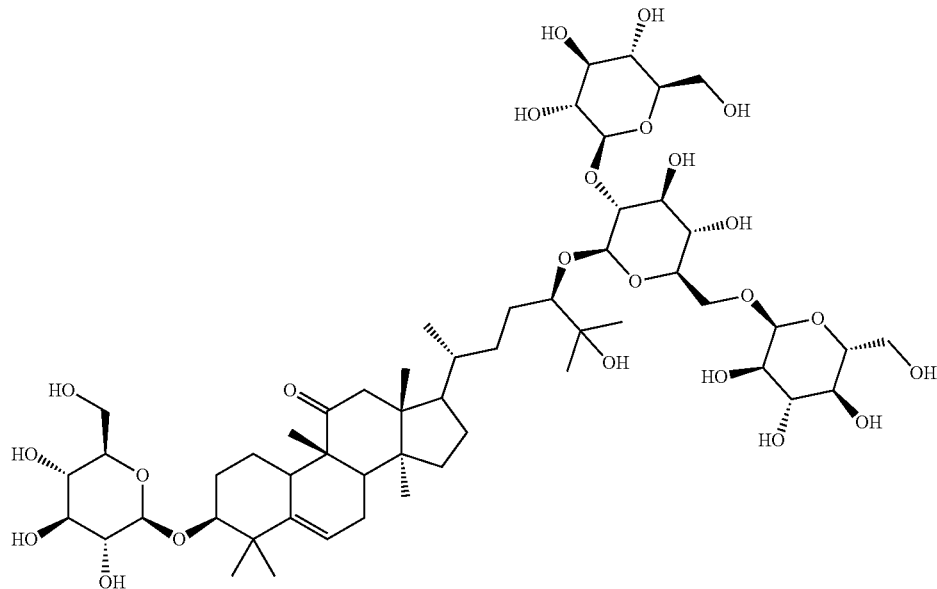 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)C(=O)C[C@]12C]

As disclosed herein, Compound 11 can be an intermediate mogroside compound produced during the production of Compound 1 disclosed herein. For example, a method for producing Compound 11 can also lead to the production of Compound 1, the method can comprise contacting Mogroside $III_E$ or 11-oxo-$MIII_E$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 11 can comprise: contacting one or more of Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a CGTase from *Bacillus licheniformis* or Toruzyme can be used.

Example 16: Production of Compound 12

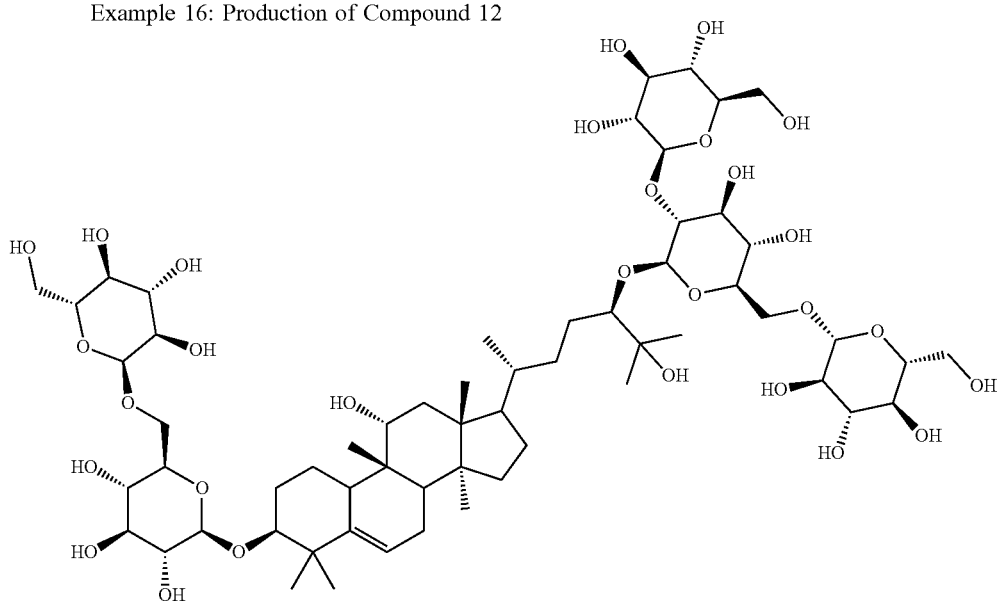

As disclosed herein, Compound 12 can be an intermediate mogroside compound that can be used in the production of Compound 1, disclosed herein. For example, a method for producing Compound 12 can also lead to the production of Compound 1, the method can comprise contacting Mogroside VI isomer with a recombinant host cell expressing one or more of UDP glycosyltransferases, CGTases, glycotransferases, dextransucrases, cellulases, β-glucosidases, amylases, transglucosidases, pectinases, invertases and dextranases. The enzyme can be an invertase enzyme from baker's yeast, for example.

As another example, the method for producing Compound 12 can comprise: contacting one or more of Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, Mogroside VI isomer and Mogroside III with a recombinant host cell expressing one or more of UDP glycosyltransferases, CGTases, glycotransferases, dextransucrases, cellulases, β-glucosidases, amylases, transglucosidases, pectinases, invertases and dextranases.

Example 17: Production of Compound 13

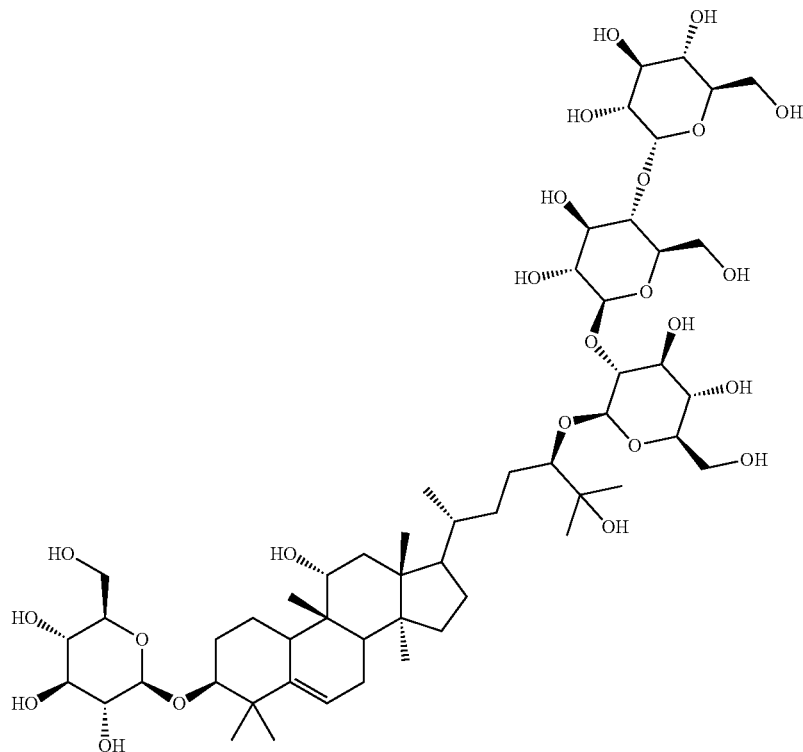 [SMILES: C[C@H](CC[C@@H](O[C@@H]1O[C@H](CO)[C@@H](O)[C@H](O)[C@H]1O[C@@H]1O[C@H](CO)[C@@H](O[C@H]2O[C@H](CO)[C@@H](O)[C@H](O)[C@H]2O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

As disclosed herein, Compound 13 can be an intermediate mogroside produced during the production of Compound 1 disclosed herein. For example, the method can comprise contacting Mogroside III$_E$ with a recombinant host cell expressing one or more of UDP glycosyltransferases, CGTases, glycotransferases, dextransucrases, cellulases, β-glucosidases, amylases, transglucosidases, pectinases, and dextranases. The enzyme expressed can also be a celluclast, for example.

As another example, the method for producing Compound 13 can comprise: contacting one or more of Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a celluclast can be used.

Example 18: Production of Compound 14

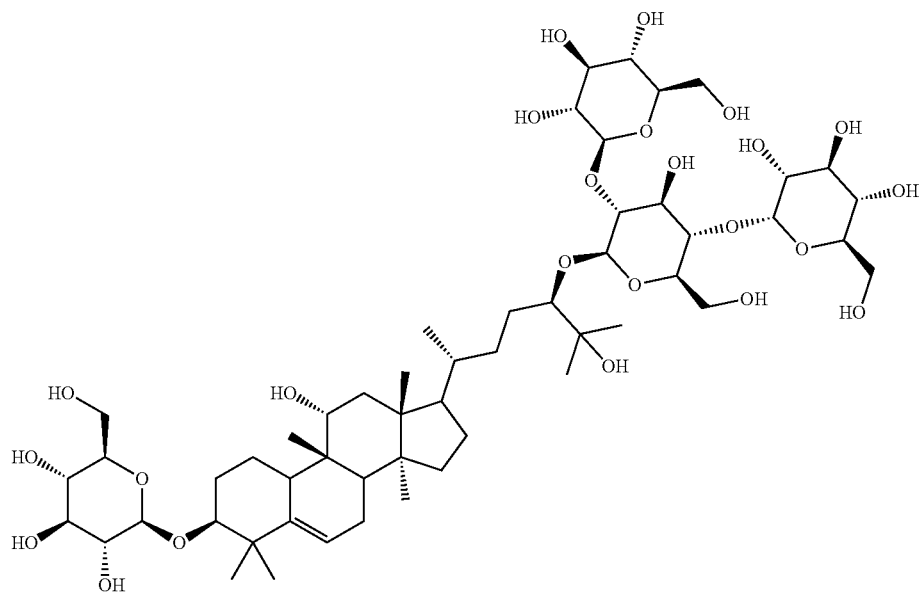 [SMILES: C[C@H](CC[C@@H](O[C@@H]1O[C@H](CO)[C@@H](O[C@H]2O[C@H](CO)[C@@H](O)[C@H](O)[C@H]2O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

As disclosed herein, Compound 14 can be an intermediate mogroside compound produced during the production of Compound 1 disclosed herein. For example, the method can comprise contacting Mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases. The enzyme expressed can also be a celluclast, for example.

As another example, the method for producing Compound 14 can comprise: contacting one or more of Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a celluclast can be used. The method can also require the presence of a sugar, such as α-lactose, for example.

Example 19: Production of Compound 15

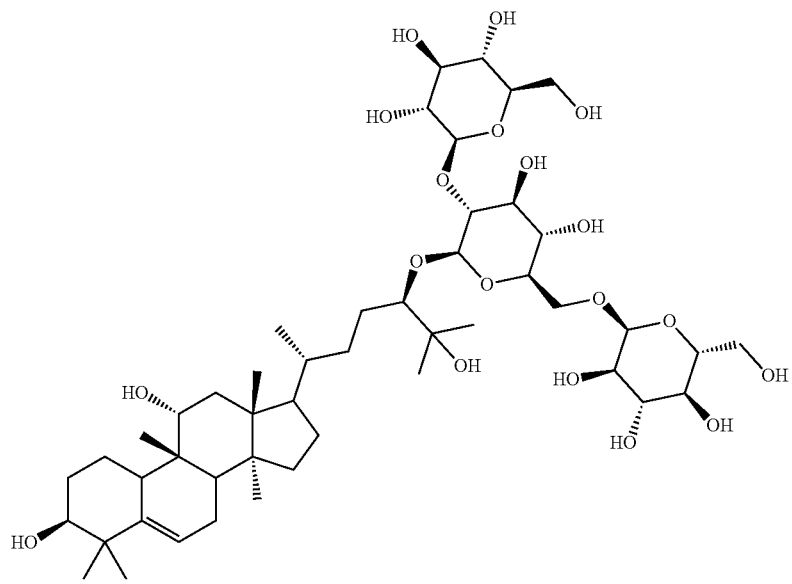 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O)C4(C)C)[C@]3(C)[C@H](O)C[C@]12C]

As disclosed herein, Compound 15 can be an intermediate mogroside compound that can be used for the production of Compound 1 disclosed herein. For example, the method can comprise contacting mogroside II$_A$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 15 can comprise: contacting one or more of Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a toruzyme can be used.

Example 20: Production of Compound 16

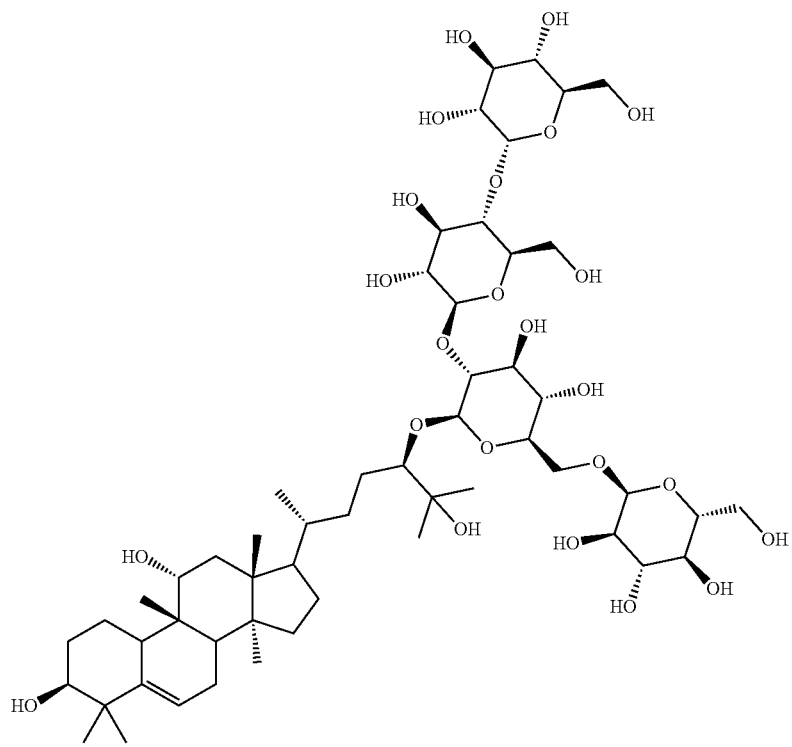 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O[C@H]2O[C@H](CO)[C@@H](O)[C@H](O)[C@H]2O)[C@H](O)[C@H]1O)C(C)(C)O)C1CC[C@@]2(C)C3CC=C4C(CC[C@H](O)C4(C)C)[C@]3(C)[C@H](O)C[C@]12C]

As disclosed herein, Compound 16 can be an intermediate mogroside compound that can be used for the production of Compound 1 disclosed herein. For example, the method can comprise contacting mogroside II$_A$ with a recombinant host cell expressing one or more of UDP glycosyltransferases, CGTases, glycotransferases, dextransucrases, cellulases, β-glucosidases, amylases, transglucosidases, pectinases, and dextranases.

As another example, the method for producing Compound 16 can comprise: contacting one or more of Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a toruzyme can be used.

The enzyme can be Toruzyme, for example. The recombinant cell can further comprise a gene encoding a cyclomatlodextrin glucanotransferase (e.g., Toruzyme), an invertase, a glucostransferase (e.g., UGT76G1), for example.

Example 21: Production of Compound 17

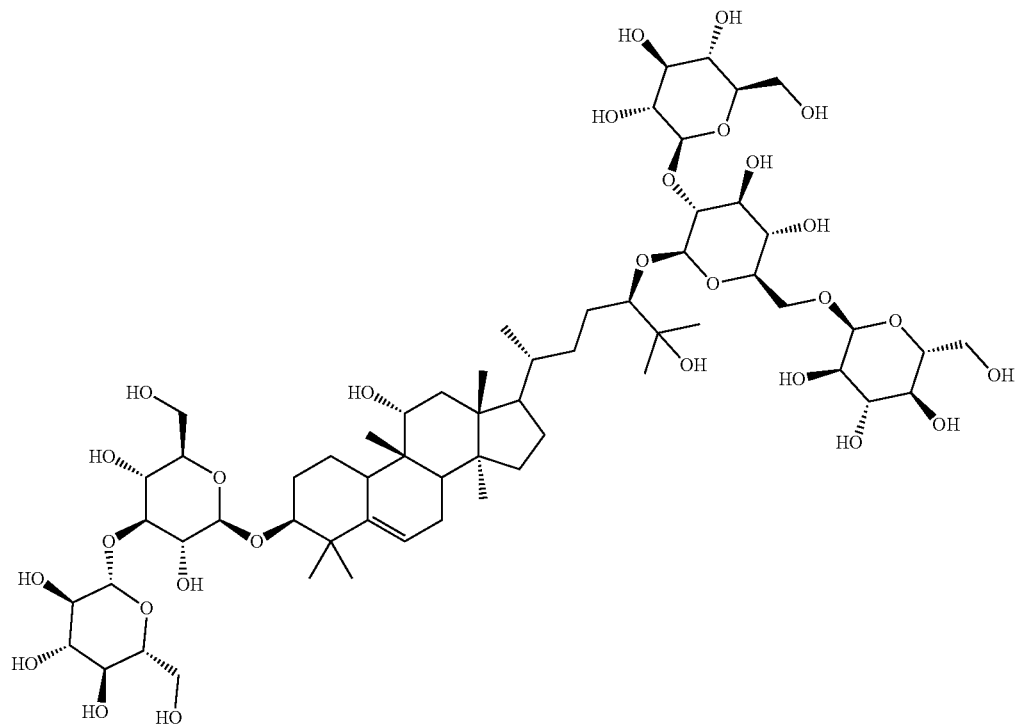 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O[C@@H]6O[C@H](CO)[C@@H](O)[C@H](O)[C@H]6O)[C@H]5O)C4(C)C)[C@]3(C)[C@H](O)C[C@]12C]

As disclosed herein, Compound 17 can be an intermediate mogroside compound for the production of Compound 1 disclosed herein. For example, Compound 17 may be hydrolyzed to produce mogroside IIIE which can then be used to produce Compound 1. For example, a method for producing Compound 17 can comprise: contacting Siamenoside I with a recombinant host cell expressing one or more of UDP glycosyltransferases, CGTases, glycotransferases, dextransucrases, cellulases, β-glucosidases, transglucosidases, sucrose synthases, pectinases, and dextranases. For example, a recombinant cell expressing a UDP glycosyltransferase can be used.

As another example, the method for producing Compound 17 can comprise: contacting one or more of Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. For example, a UDP glycosyltransferases can be used.

Example 22: Production of Compound 18

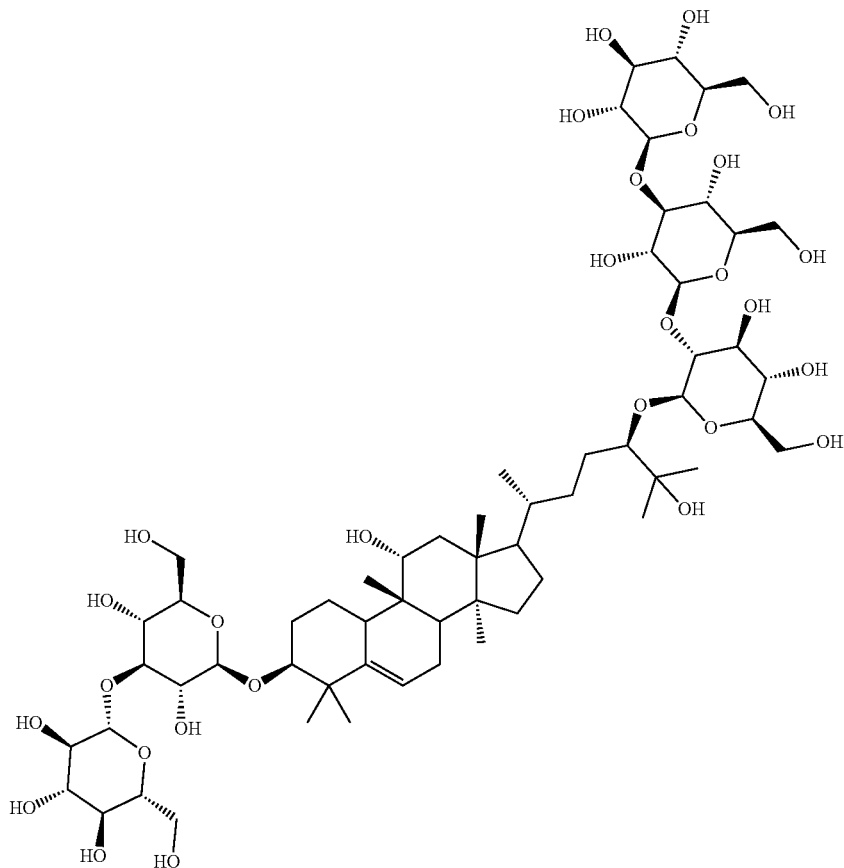 [SMILES: C[C@H](CC[C@@H](O[C@@H]1O[C@H](CO)[C@@H](O)[C@H](O)[C@H]1O[C@@H]1O[C@H](CO)[C@@H](O)[C@H](O[C@@H]2O[C@H](CO)[C@@H](O)[C@H](O)[C@H]2O)[C@H]1O)C(C)(C)O)C1CC[C@@]2(C)C3CC=C4C(CC[C@H](O[C@@H]5O[C@H](CO)[C@@H](O)[C@H](O[C@@H]6O[C@H](CO)[C@@H](O)[C@H](O)[C@H]6O)[C@H]5O)C4(C)C)[C@]3(C)[C@H](O)C[C@]12C]

As disclosed herein, Compound 18 can be an intermediate mogroside compound produced during the production of Compound 1 disclosed herein. For example, Compound 18 may be hydrolyzed to produce mogroside IIIE which can then be used to produce Compound 1. For example, a method for producing Compound 18 can also lead to the production of Compound 1, the method can comprise contacting Mogroside III$_E$ with a recombinant host cell expressing one or more of UDP glycosyltransferases, CGTases, glycotransferases, dextransucrases, cellulases, β-glucosidases, amylases, transglucosidases, pectinases, and dextranases. The enzymes can be Sus1 and UGT76G1 for example.

As another example, the method for producing Compound 18 can comprise: contacting one or more of Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be UGT76G1, for example.

Example 23: Production of Compound 19

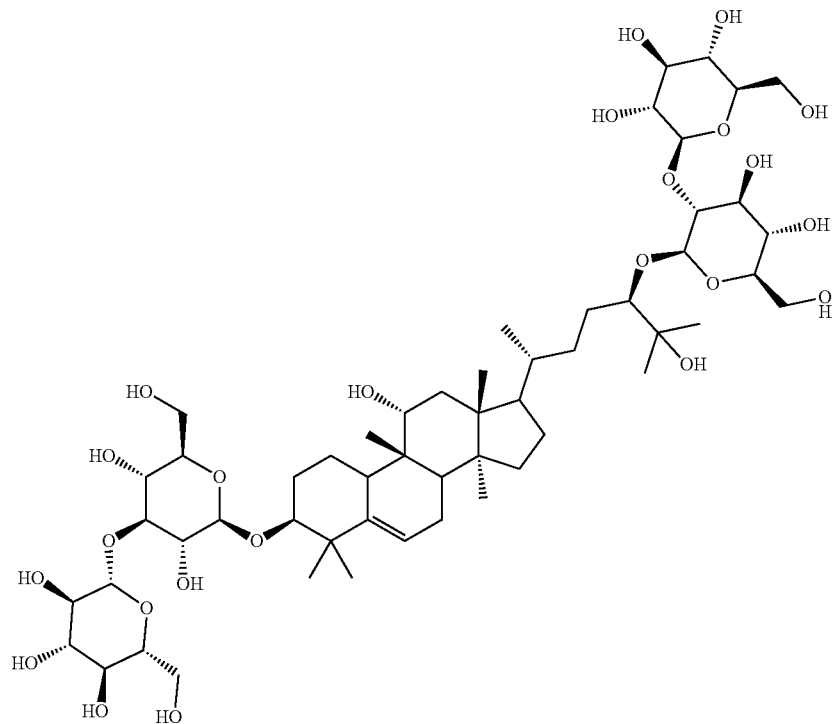 [SMILES: C[C@H](CC[C@@H](O[C@@H]1O[C@H](CO)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O[C@@H]6O[C@H](CO)[C@@H](O)[C@H](O)[C@H]6O)[C@H]5O)C4(C)C)[C@]3(C)[C@H](O)C[C@]12C]

As disclosed herein, Compound 19 can be an intermediate mogroside compound produced during the production of Compound 1 disclosed herein. Compound 19 can be further hydrolyzed to produce Compound 1, for example. For example, a method for producing Compound 18 can also lead to the production of Compound 1, the method can comprise contacting Mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases. The enzymes can be Sus1 and UGT76G1 for example.

As another example, the method for producing Compound 19 can comprise: contacting one or more of Mogroside V, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be UGT76G1, for example. The enzyme can also be sucrose synthase Sus1, for example.

Example 24: Production of Compound 20

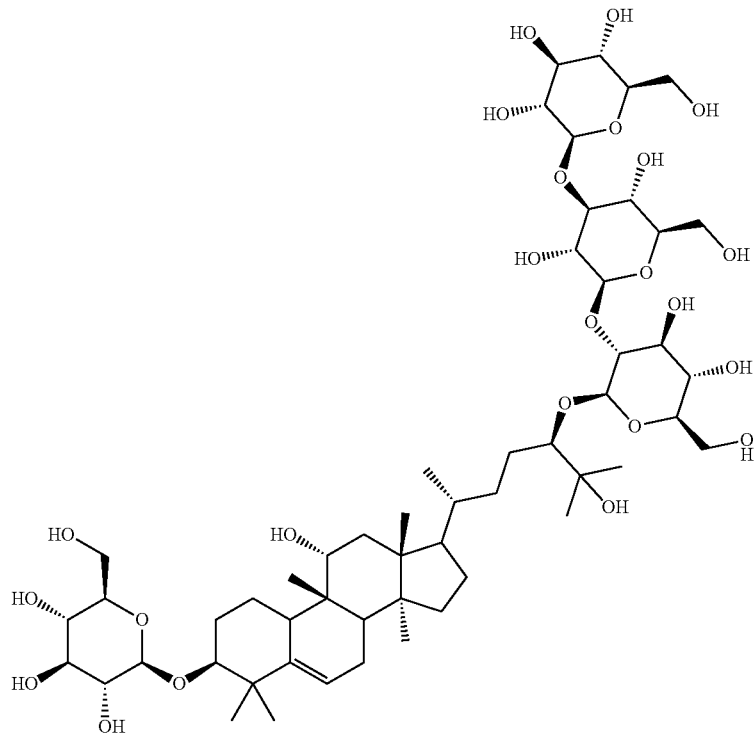 [SMILES: C[C@H](CC[C@@H](O[C@@H]1O[C@H](CO)[C@@H](O)[C@H](O)[C@H]1O[C@@H]1O[C@H](CO)[C@@H](O)[C@H](O[C@@H]2O[C@H](CO)[C@@H](O)[C@H](O)[C@H]2O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

As disclosed herein, Compound 20 can be an intermediate mogroside compound produced during the production of Compound 1 disclosed herein. Compound 20 can be further hydrolyzed to produce Compound 1, for example. For example, a method for producing Compound 20 can also lead to the production of Compound 1, the method can comprise contacting Mogroside III$_E$ with a recombinant host cell expressing one or more of UDP glycosyltransferases, CGTases, glycotransferases, dextransucrases, cellulases, β-glucosidases, amylases, transglucosidases, pectinases, and dextranases. The enzymes can be Sus1 and UGT76G1 for example.

As another example, the method for producing Compound 20 can comprise: contacting one or more of Mogroside V, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be UGT76G1, for example. The enzyme can also be sucrose synthase Sus1, for example. The enzyme can be sucrose synthase Sus1 and UGT76G1, for example.

Example 25: Production of Compound 21

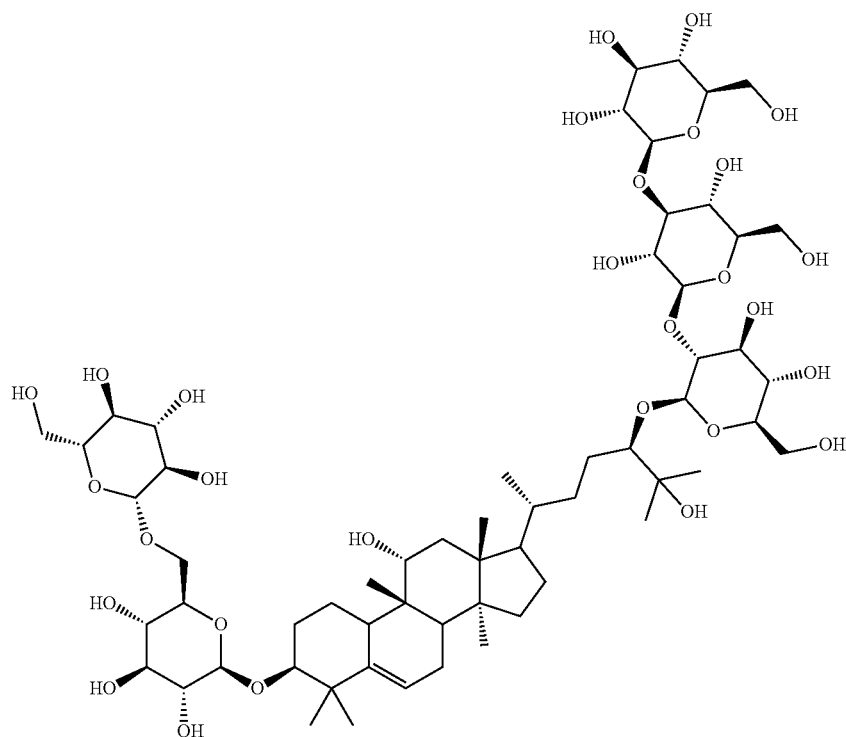 [SMILES: C[C@H](CC[C@@H](O[C@@H]1O[C@H](CO)[C@@H](O)[C@H](O)[C@H]1O[C@@H]1O[C@H](CO)[C@@H](O)[C@H](O[C@@H]2O[C@H](CO)[C@@H](O)[C@H](O)[C@H]2O)[C@H]1O)C(C)(C)O)C1CC[C@@]2(C)C3CC=C4C(CC[C@H](O[C@@H]5O[C@H](CO[C@@H]6O[C@H](CO)[C@@H](O)[C@H](O)[C@H]6O)[C@@H](O)[C@H](O)[C@H]5O)C4(C)C)[C@]3(C)[C@H](O)C[C@]12C]

As disclosed herein, Compound 21 can be an intermediate mogroside compound produced during the production of Compound 1 disclosed herein. Compound 21 can be further hydrolyzed to produce Compound 1, for example. For example, a method for producing Compound 21 can also lead to the production of Compound 1, the method can comprise contacting Mogroside IV$_E$ with a recombinant host cell expressing one or more of UDP glycosyltransferases, CGTases, glycotransferases, dextransucrases, cellulases, β-glucosidases, amylases, transglucosidases, pectinases, and dextranases. The enzymes can be Sus1 and UGT76G1 for example.

As another example, the method for producing Compound 21 can comprise: contacting one or more of Mogroside V, Mogroside IV$_E$, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be UGT76G1, for example. The enzyme can also be sucrose synthase Sus1, for example. The enzymes can be sucrose synthase Sus1 and GT76G1, for example.

Example 26: Production of Compound 22

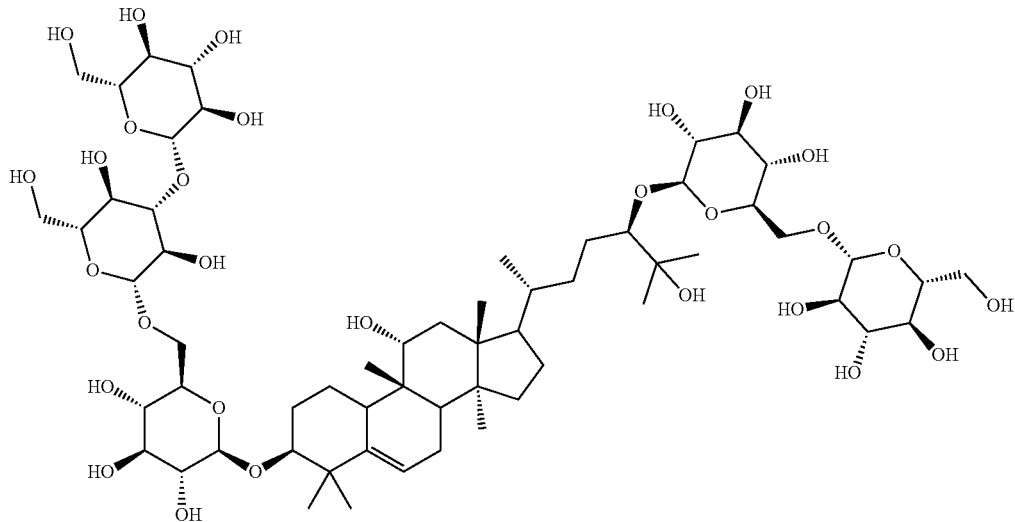 [SMILES: C[C@H](CC[C@@H](O[C@@H]1O[C@H](CO[C@@H]2O[C@H](CO)[C@@H](O)[C@H](O)[C@H]2O)[C@@H](O)[C@H](O)[C@H]1O)C(C)(C)O)C1CC[C@@]2(C)C3CC=C4C(CC[C@H](O[C@@H]5O[C@H](CO[C@@H]6O[C@H](CO)[C@@H](O)[C@H](O[C@@H]7O[C@H](CO)[C@@H](O)[C@H](O)[C@H]7O)[C@H]6O)[C@@H](O)[C@H](O)[C@H]5O)C4(C)C)[C@]3(C)[C@H](O)C[C@]12C]

As disclosed herein, Compound 22 can be an intermediate mogroside compound produced during the production of Compound 1 disclosed herein. Compound 22 can be further hydrolyzed to produce Compound 1, for example. For example, a method for producing Compound 22 can also lead to the production of Compound 1, the method can comprise contacting Mogroside $IV_A$ with a recombinant host cell expressing one or more of UDP glycosyltransferases, CGTases, glycotransferases, dextransucrases, cellulases, β-glucosidases, amylases, transglucosidases, pectinases, and dextranases. The enzymes can be Sus1 and UGT76G1 for example.

As another example, the method for producing Compound 22 can comprise: contacting one or more of Mogroside V, Mogroside $IV_E$, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be UGT76G1, for example. The enzyme can also be sucrose synthase Sus1, for example. The enzymes can be sucrose synthase Sus1 and GT76G1, for example.

Example 27: Production of Compound 23

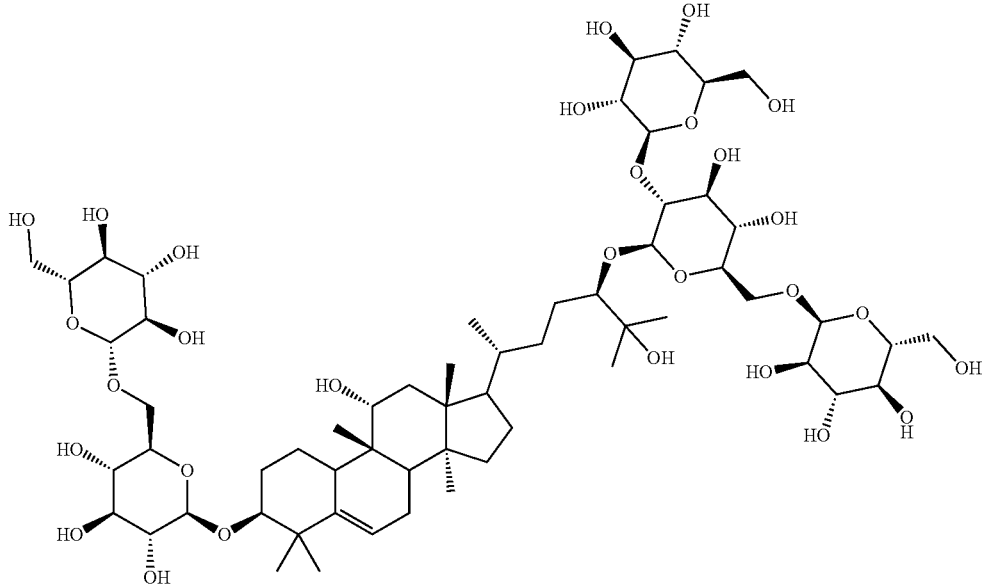 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO[C@@H]6O[C@H](CO)[C@@H](O)[C@H](O)[C@H]6O)[C@@H](O)[C@H](O)[C@H]5O)C4(C)C)[C@]3(C)[C@H](O)C[C@]12C]

As disclosed herein, Compound 23 can be an intermediate mogroside compound produced during the production of Compound 1 disclosed herein. Compound 23 can be further hydrolyzed to produce Compound 1, for example. For example, a method for producing Compound 22 can also lead to the production of Compound 1, the method can comprise contacting Mogroside $IV_E$ with a recombinant host cell expressing one or more of UDP glycosyltransferases, CGTases, glycotransferases, dextransucrases, cellulases, β-glucosidases, amylases, transglucosidases, pectinases, and dextranases. The enzyme can be dextransucrase, for example.

As another example, the method for producing Compound 23 can comprise: contacting one or more of Mogroside V, Mogroside $IV_E$, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be detransucrase, for example, which will hydrolyze the hyper glycosylated mogroside $IV_E$ isomers to the desired mogroside V isomer.

Examples 28 and 29: Production of Mogroside $II_{A1}$ and Mogroside $II_{A2}$ from Fungal Lactase As disclosed herein, Mogroside $II_{A1}$ and Mogroside $II_{A2}$ can be intermediate mogroside compound produced during the production of Compound 1 disclosed herein. Mogroside $II_{A1}$ and Mogroside $II_{A2}$ can be further hydrolyzed to produce Compound 1, for example. For example, a method for producing Mogroside $II_{A1}$ and Mogroside $II_{A2}$ can also lead to the production of Compound 1, the method can comprise contacting Mogroside $IV_E$ with a recombinant host cell expressing one or more of UDP glycosyltransferases, CGTases, glycotransferases, dextransucrases, cellulases, β-glucosidases, amylases, transglucosidases, pectinases, and dextranases. The enzyme can be a lactase from a fungus, for example.

As another example, the method for producing Mogroside $II_{A1}$ and Mogroside $II_{A2}$ can include: contacting one or more of Mogroside V, Mogroside $IV_E$, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases.

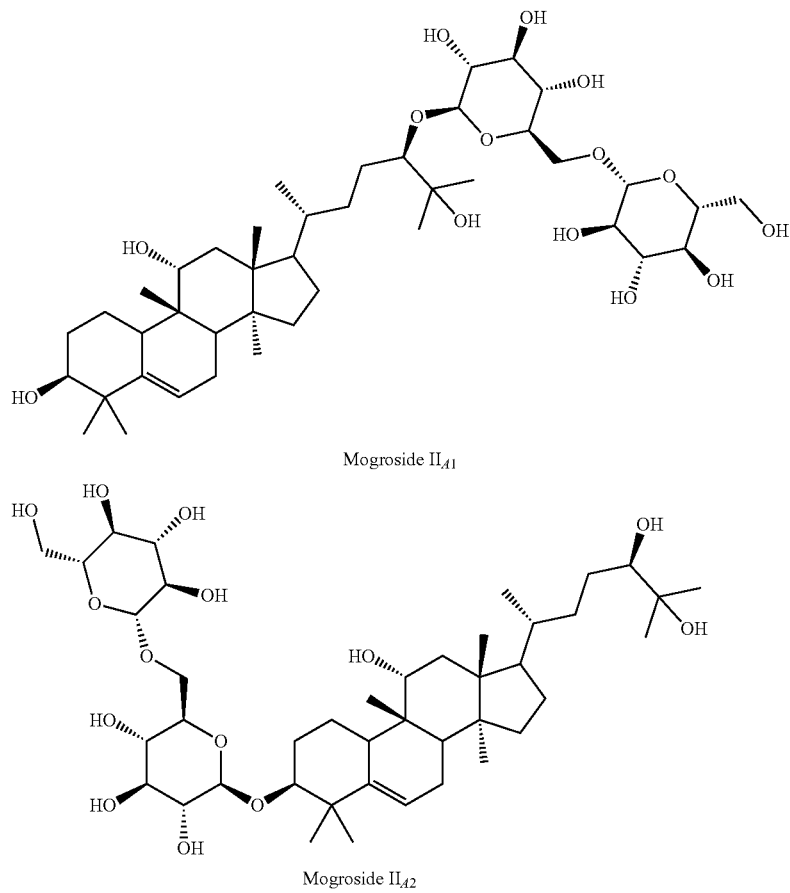

Mogroside $II_{A1}$

Mogroside $II_{A2}$

Example 30: Production of Mogroside I$_A$ from Viscozyme

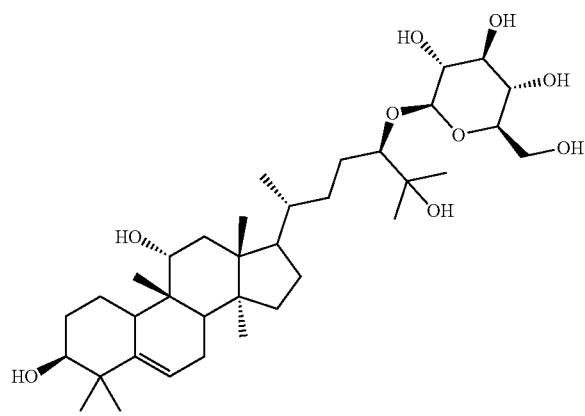 [SMILES: C[C@H](CC[C@@H](O[C@@H]1O[C@H](CO)[C@@H](O)[C@H](O)[C@H]1O)C(C)(C)O)C1CC[C@@]2(C)C3CC=C4C(CC[C@H](O)C4(C)C)[C@]3(C)[C@H](O)C[C@]12C]

As disclosed herein, Mogroside I$_A$ can be intermediate mogroside compound produced during the production of Compound 1 disclosed herein. Mogroside I$_{A\_}$can be further hydrolyzed to produce Compound 1, for example. A method for producing Mogroside LA can also lead to the production of Compound 1, the method can comprise contacting Mogroside II$_A$ with a recombinant host cell expressing one or more of UDP glycosyltransferases, CGTases, glycotransferases, dextransucrases, cellulases, β-glucosidases, amylases, transglucosidases, pectinases, and dextranases. The enzyme can be Viscozyme, for example.

As another example, the method for producing Mogroside I$_A$ can comprise: contacting one or more of Mogroside V, Mogroside IV$_E$, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be Viscozyme, for example.

Example 31: Production of Compound 24

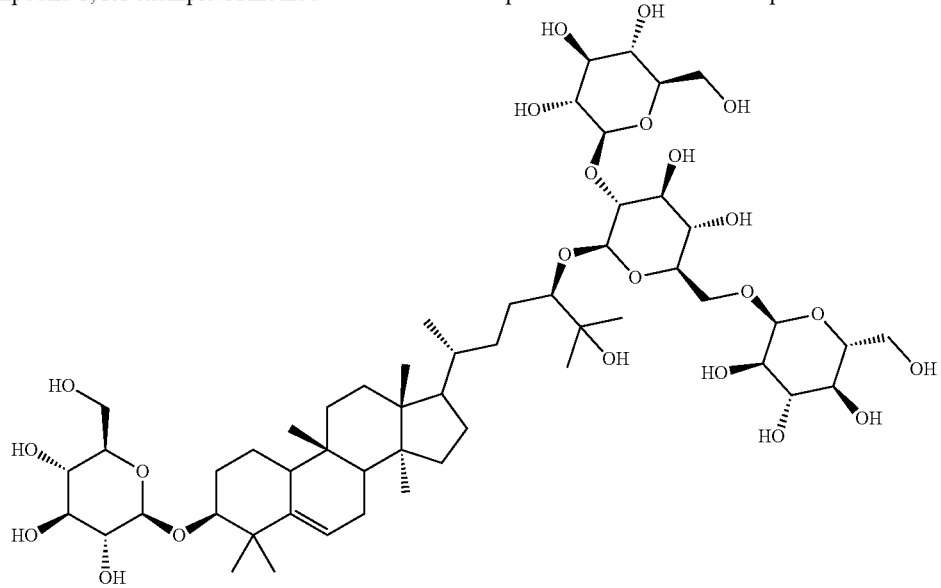

As disclosed herein, Compound 24 can be intermediate mogroside compound produced during the production of Compound 1 disclosed herein. Compound 24 can be further hydrolyzed to produce Compound 1, for example. A method for producing Compound 24_can also lead to the production of Compound 1, the method can comprise contacting mogroside III$_E$ with a recombinant host cell expressing one or more of UDP glycosyltransferases, CGTases, glycotransferases, dextransucrases, cellulases, β-glucosidases, amylases, transglucosidases, pectinases, and dextranases. The enzyme can be dextransucrase DexT, for example.

As another example, the method for producing Compound 24 can comprise: contacting one or more of Mogroside V, Mogroside IV$_E$, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be dextransucrase DexT, for example.

Example 32: Production of Compound 25

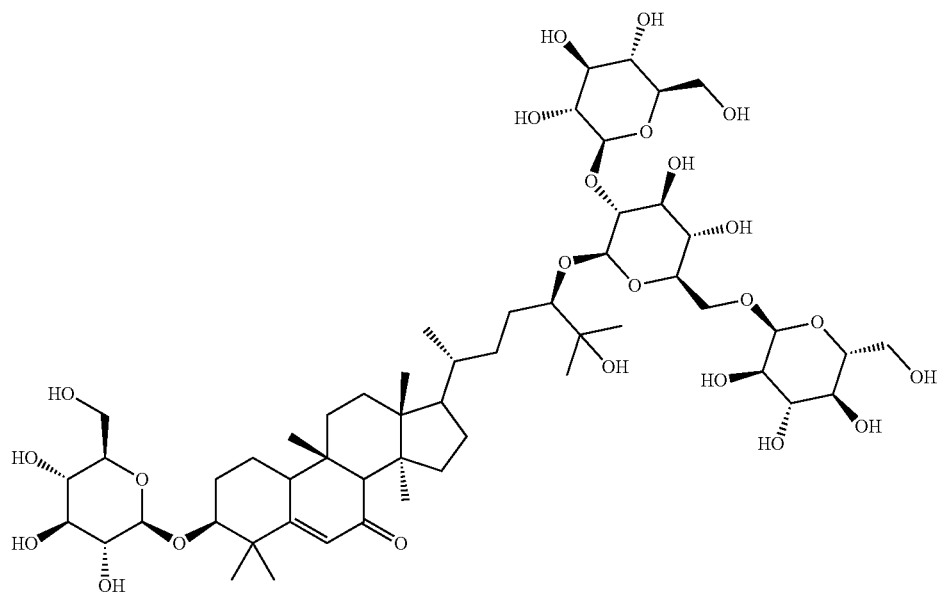 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3C(=O)C=C4C(CC[C@H](O[C@@H]5O[C@H](CO)[C@@H](O)[C@H](O)[C@H]5O)C4(C)C)[C@]3(C)CC[C@]12C]

As disclosed herein, Compound 25 can be intermediate mogroside compound produced during the production of Compound 1 disclosed herein. Compound 25 can be further hydrolyzed to produce Compound 1, for example. A method for producing Compound 25_can also lead to the production of Compound 1, the method can comprise contacting mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases. The enzyme can be dextransucrase DexT, for example.

As another example, the method for producing Compound 25 can comprise: contacting one or more of Mogroside V, Mogroside $IV_E$, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be dextransucrase DexT, for example.

Example 33: Production of Compound 26

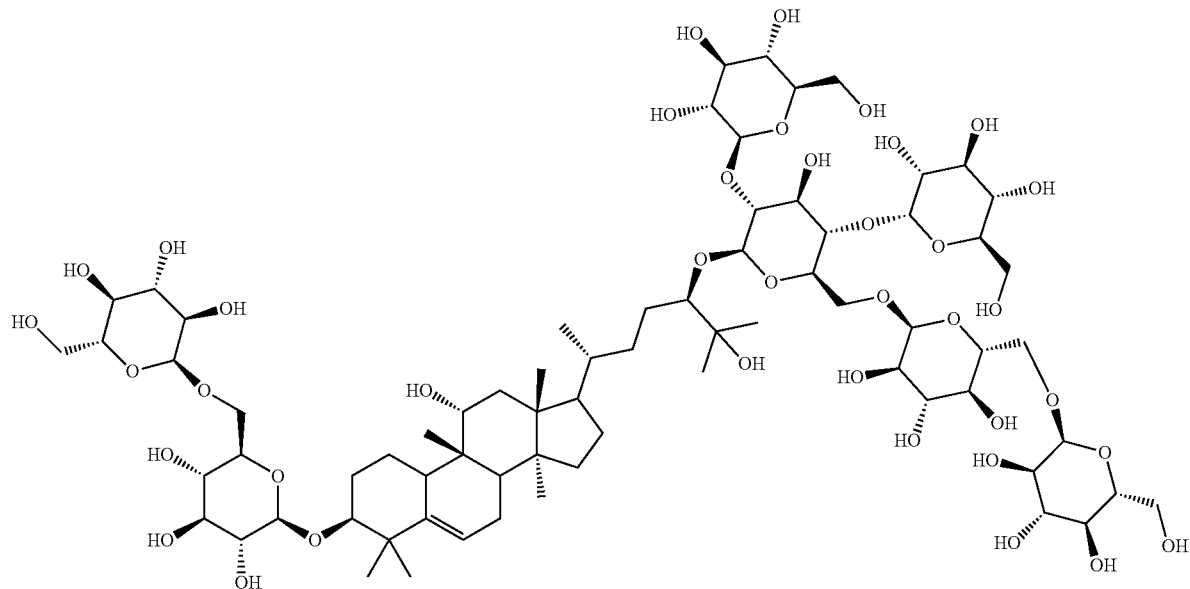 [SMILES: C[C@H](CC[C@@H](O[C@@H]1O[C@H](CO[C@H]2O[C@H](CO[C@H]3O[C@H](CO)[C@@H](O)[C@H](O)[C@H]3O)[C@@H](O)[C@H](O)[C@H]2O)[C@@H](O[C@H]2O[C@H](CO)[C@@H](O)[C@H](O)[C@H]2O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO[C@H]6O[C@H](CO)[C@@H](O)[C@H](O)[C@H]6O)[C@@H](O)[C@H](O)[C@H]5O)C4(C)C)[C@]3(C)[C@H](O)C[C@]12C]

As disclosed herein, Compound 26 can be intermediate mogroside compound produced during the production of Compound 1 disclosed herein. Compound 26 can be further hydrolyzed to produce Compound 1, for example. A method for producing Compound 26 can also lead to the production of Compound 1, the method can comprise contacting mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases. The enzyme can be dextransucrase DexT, for example.

As another example, the method for producing Compound 26 can include: contacting one or more of Mogroside V, Mogroside $IV_E$, Siamenoside I, Mogroside $IV_E$, Isomogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be dextransucrase DexT, for example.

Examples 34 and 35: Production of Mogrol and Mogroside $I_E$ from Pectinase

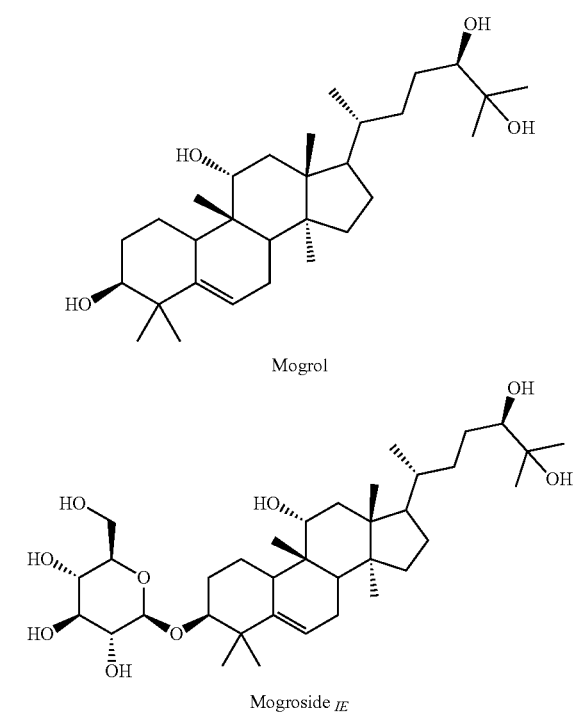

Mogrol

Mogroside $I_E$

As disclosed herein, Mogrol and Mogroside $I_E$ can be intermediate mogroside compounds produced during the production of Compound 1 disclosed herein. Mogrol can be used as a substrate for producing Mogroside $I_{A1}$, which is further hydrolyzed to form Compound 1 and Mogroside $I_E$ can be further hydrolyzed to produce Compound 1, for example. A method for producing Mogrol and Mogroside can also lead to the production of Compound 1, the method can comprise contacting mogroside V with a recombinant host cell expressing one or more of UDP glycosyltransferases, CGTases, glycotransferases, dextransucrases, cellulases, β-glucosidases, amylases, transglucosidases, pectinases, and dextranases. The enzyme can be pectinase enzyme from *Aspergillus aculeatus*, for example.

As another example, the method for producing Mogrol and Mogroside $I_E$ can comprise: contacting one or more of Mogroside V, Mogroside $IV_E$, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases.

Example 36: Production of Mogroside $II_E$

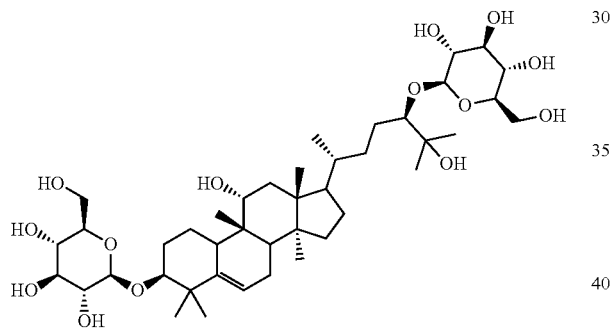

As disclosed herein, Mogroside IIE can be intermediate mogroside compounds produced during the production of Compound 1 disclosed herein. Mogroside IIE can be further hydrolyzed to produce Compound 1, for example. A method for producing Mogroside IIE can also lead to the production of Compound 1, the method can comprise contacting mogroside V with a recombinant host cell expressing one or more of UDP glycosyltransferases, CGTases, glycotransferases, dextransucrases, cellulases, β-glucosidases, amylases, transglucosidases, pectinases, and dextranases. The enzyme can be pectinase enzyme from *Aspergillus aculeatus*, for example.

As another example, the method for producing Mogroside IIE can comprise: contacting one or more of Mogroside V, Mogroside $IV_E$, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases.

Examples 37 and 38: Production of Compounds 32 and 33

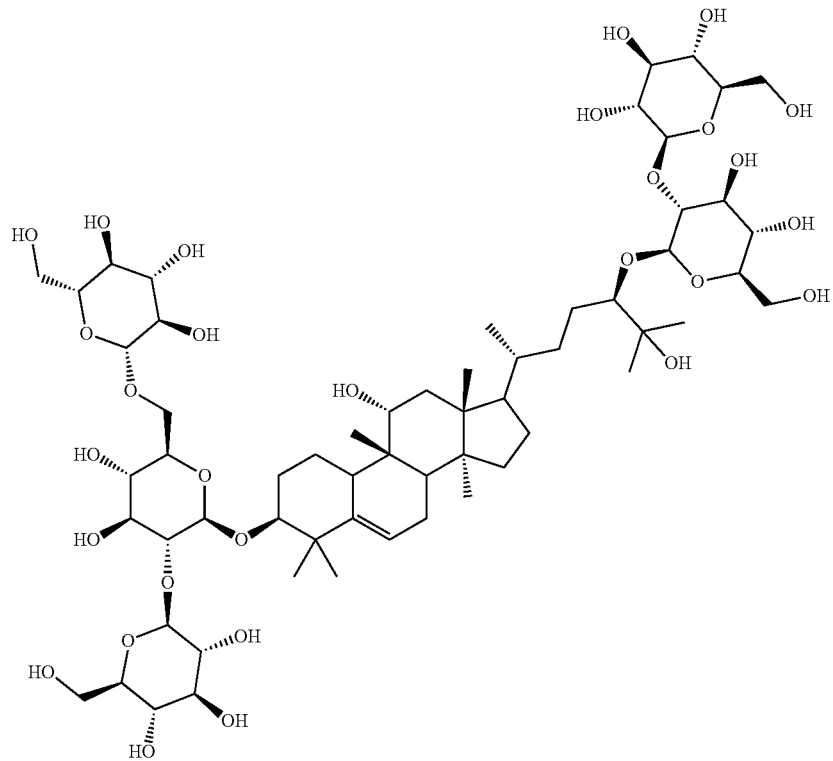

Compound 32

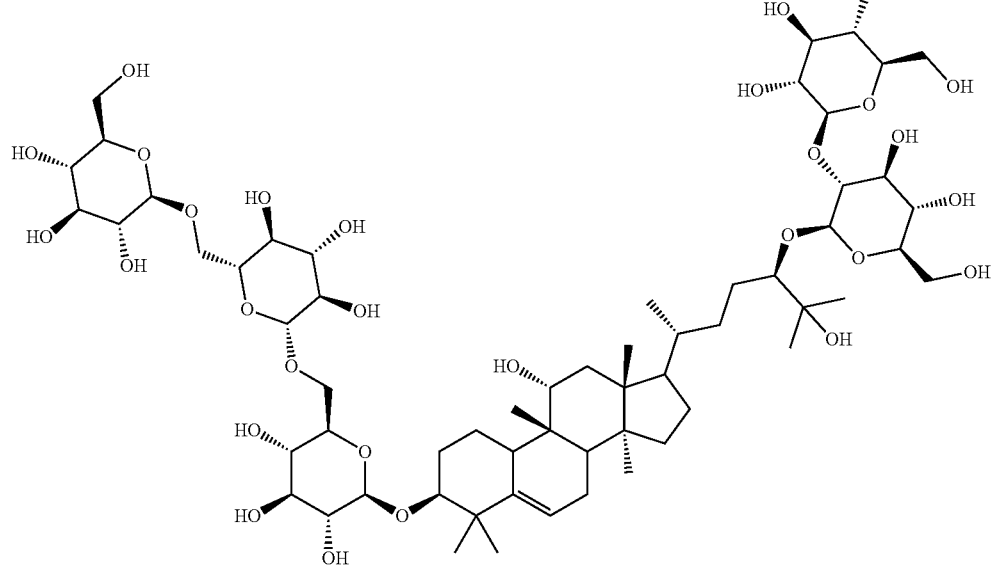

Compound 33

As disclosed herein, Compounds 32 and 33 can be intermediate mogroside compounds produced during the production of Compound 1 disclosed herein. Compounds 32 and 33 can be further glycosylated and hydrolyzed to produce Compound 1, for example. A method for producing Compounds 32 and 33 can also lead to the production of Compound 1, the method can comprise contacting one or more of Mogroside V, Mogroside IV$_E$, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases. The enzyme can be pectinase enzyme from *Aspergillus aculeatus*, for example.

As another example, the method for producing Compound 32 and 33 can comprise: contacting one or more of Mogroside V, Mogroside IV$_E$, Siamenoside I, Mogroside IV$_E$, Iso-mogroside V, Mogroside III$_E$, 11-Deoxy-mogroside V, 11-Oxo-mogroside V, Mogroside VI, Mogroside IV$_A$, Mogroside II$_A$, Mogroside II$_{A1}$, Mogroside II$_{A2}$, Mogroside I$_A$, 11-oxo-Mogroside VI, 11-oxo-Mogroside III$_E$, 11-oxo-Mogroside IV$_E$, Mogroside I$_E$, Mogrol, 11-oxo-mogrol, Mogroside II$_E$, Mogroside III$_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases.

Examples 39 and 40: Production of Compounds 34 and 35

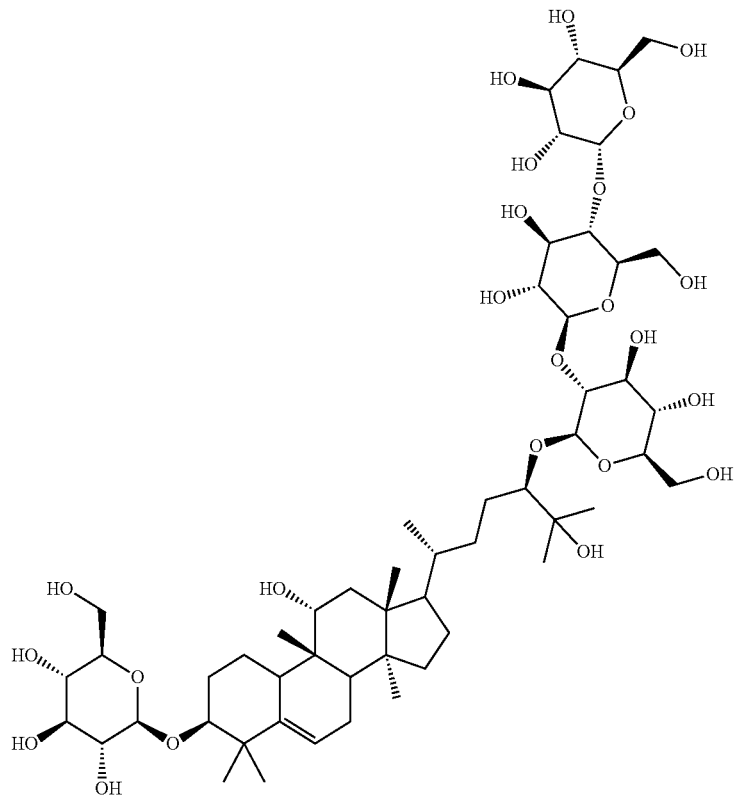

Compound 34

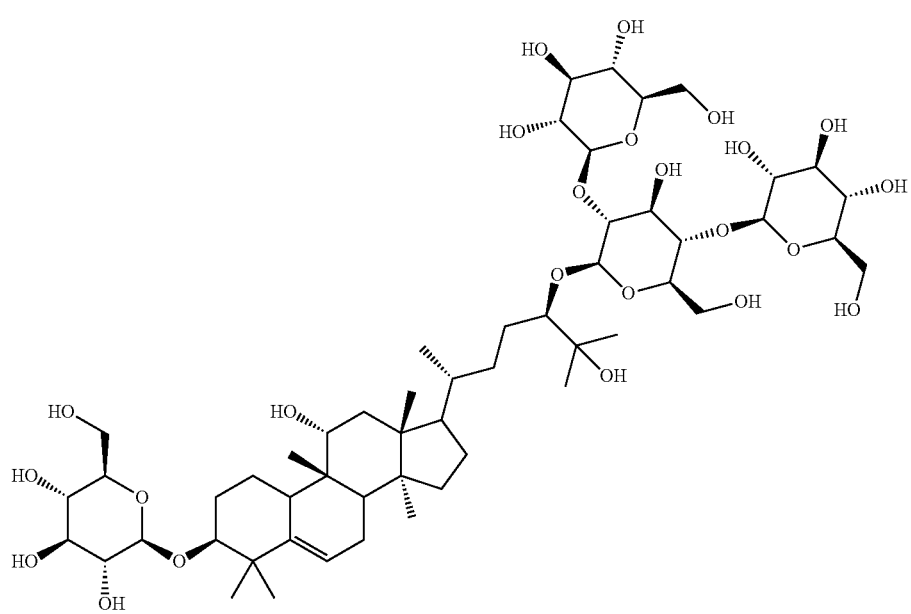

Compound 35

As disclosed herein, Compounds 34 and 35 can be intermediate mogroside compounds produced during the production of Compound 1 disclosed herein. Compounds 32 and 33 can be further glycosylated and hydrolyzed to produce Compound 1, for example. A method for producing Compounds 34 and 35 can also lead to the production of Compound 1, the method can comprise contacting mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases. The enzyme can be celluclast, for example.

As another example, the method for producing Compounds 34 and 35 can comprise: contacting one or more of Mogroside V, Mogroside $IV_E$, Siamenoside I, Mogroside $IV_E$, Iso-mogroside V, Mogroside $III_E$, 11-Deoxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, Mogroside $III_{A2}$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases.

Examples 41 and 42: Production of Mogroside $III_{A2}$ and Mogroside III

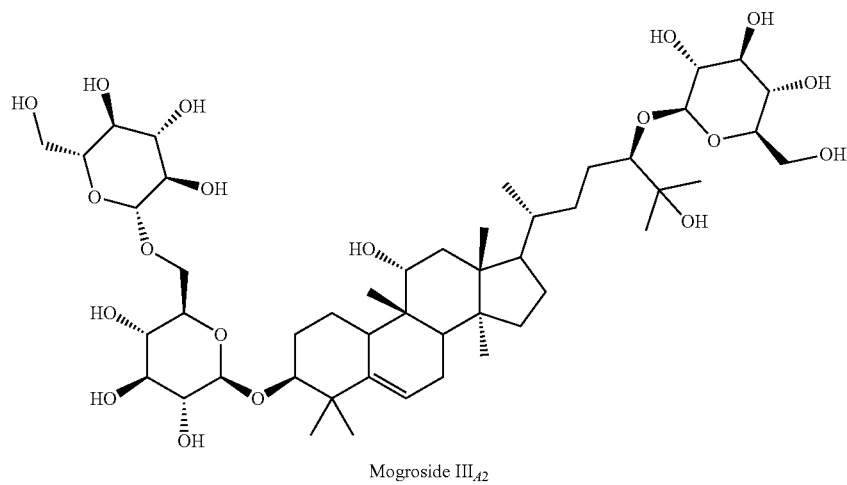

Mogroside $III_{A2}$

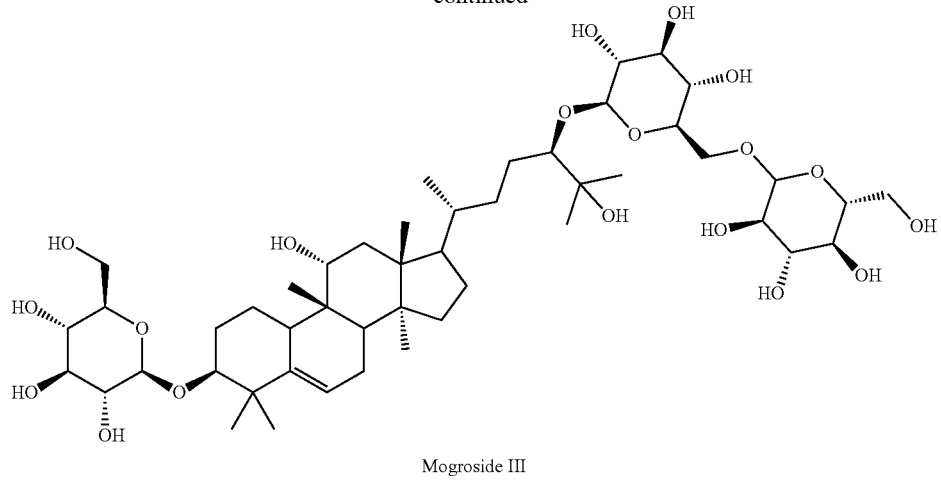

Mogroside III

As disclosed herein, Mogroside $III_{A2}$ and Mogroside III can be intermediate mogroside compounds produced during the production of Compound 1 disclosed herein. Mogroside $III_{A2}$ and Mogroside III can be further hydrolyzed to produce Compound 1, for example.

For example Mogroside $III_{A2}$ and Mogroside III can be also contact UGT to form Mogroside $IV_A$, another mogroside compound that can be used to make Mogroside $III_E$, which is further hydrolyzed to form Compound 1.

A method for producing Mogroside $III_{A2}$ and Mogroside III can also lead to the production of Compound 1, the method can comprise contacting mogroside $III_E$ with a recombinant host cell expressing one or more of UDP glycosyltransferases, CGTases, glycotransferases, dextransucrases, cellulases, β-glucosidases, amylases, transglucosidases, pectinases, and dextranases. The enzyme can be celluclast, for example.

As another example, the method for producing Mogroside $III_{A2}$ and Mogroside III can comprise: contacting one or more of Mogroside V, Mogroside $IV_E$, Siamenoside I, Mogroside $IV_E$, Iso-mogroside V, Mogroside $III_E$, 11-De-oxy-mogroside V, 11-Oxo-mogroside V, Mogroside VI, Mogroside $IV_A$, Mogroside $II_A$, Mogroside $II_{A1}$, Mogroside $II_{A2}$, Mogroside $I_A$, 11-oxo-Mogroside VI, 11-oxo-Mogroside $III_E$, 11-oxo-Mogroside $IV_E$, Mogroside $I_E$, Mogrol, 11-oxo-mogrol, Mogroside $II_E$, and Mogroside III with a recombinant host cell expressing one or more of UDP glycosyltransferases, CGTases, glycotransferases, dextransucrases, cellulases, β-glucosidases, amylases, transglucosidases, pectinases, and dextranases.

Example 43: Use of CGT-SL Enzyme to Produce Compound 1

In 1 ml reaction volume, 5 mg of Mogroside IIIE, 50 mg of soluble starch, 0.1M NaOAC pH 5.0, 125 ul of CGT-SL enzyme (from *Geobacillus thermophillus*) and water was mixed and with a stir bar and incubated at 50 C. Time point samples were taken for HPLC.

HPLC Data: Mass spec of Compound 1 production as shown in FIG. 1. In some embodiments, CTG-SL can comprise a sequence set forth in SEQ ID NO: 3, 148 or 154.

Example 44: Cloning: Gene Encoding for Dextransucrase Enzyme was PCR Amplified from *Leuconostoc citreum* ATCC11449 and Cloned into pET23a Growth conditions: BL21 Codon Plus RIL strain was grown in 2×YT at 37 C, 250 rpm until OD600 of 1. 10 mM of lactose was added for induction, incubated at room temperature, 150 rpm overnight. Crude extract used for the reaction was obtained either by sonication or osmotic shock.

In some embodiments, the dextransucrase comprises, or consists of, an amino acid sequence of any one of SEQ ID NOs: 2, 103, 106-110, 156, and 896. In some embodiments, the DexT can comprise an amino acid sequence set forth in SEQ ID NO: 103. In some embodiments, the DexT comprises a nucleic acid sequence set forth in SEQ ID NO: 104 or 105.

Example 45: Reaction of Mogroside IIIE with *S mutans* Clarke ATCC25175 Dextransucrase to Produce Compound 1

Figure 2:
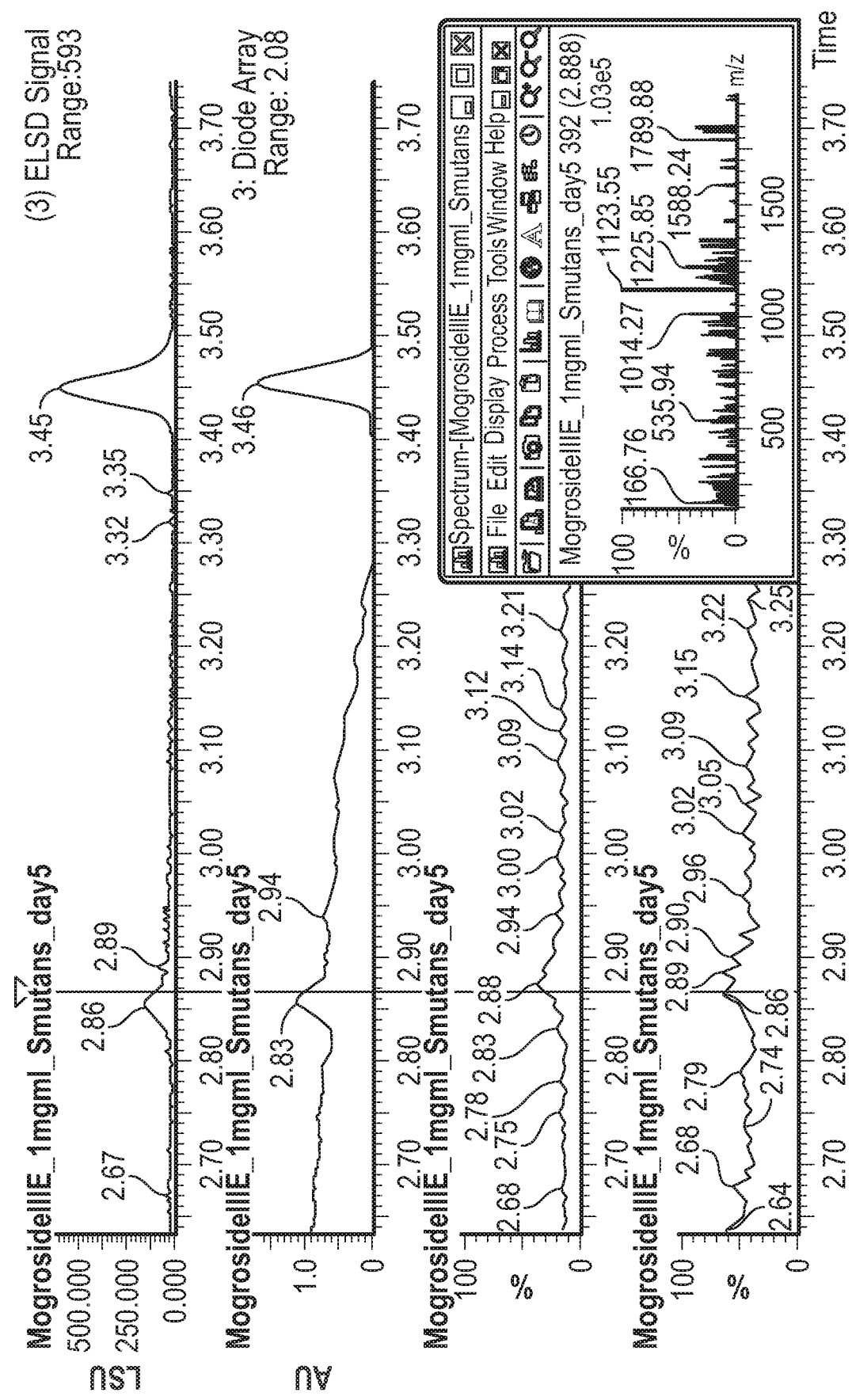
FIG. 2 shows HPLC data and mass spectroscopy data (inset) of Compound 1 production after treatment of Mogroside IIIE with Streptococcus mutans Clarke ATCC 25175 Dextransucrase.

Growth conditions: The strain indicated above was grown anaerobically with glucose supplementation as indicated in Wenham, Henessey and Cole (1979) to stimulate dextransucrase production. 5 mg/ml Mogroside $III_E$ was added to the growth media. Time point samples were taken for HPLC. HPLC Data is presented as mass spec of Compound 1 production in FIG. 2.

Example 46: Reaction of Mogroside IIIE with CGTase

In 1 ml reaction volume, 5 mg of Mogroside IIIE, 50 mg of soluble starch, 0.1M NaOAC pH 5.0, 125 ul of enzyme and water was mixed and with a stir bar and incubated at 50 C. Time point samples were taken for HPLC. The enzyme used was CGTase. The product of Compound 1 is seen in the HPLC data and mass spectroscopy data as shown in FIG. 1. Mass peaks correspond to the size of Compound 1.

Example 47: Reaction of Mogroside IIIE with Celluclast

Celluclast xylosylation were performed with mogroside IIIE with celluclast from the native host: *Trichoderma reesei*

Reaction conditions: 5 mg of Mogroside IIIE, 100 mg xylan, 50 ul Celluclast were mixed in a total volume of 1 ml with 0.1M sodium acetate pH 5.0, incubated at 50 C with stirring. Time point samples were taken for HPLC.

Figure 3:
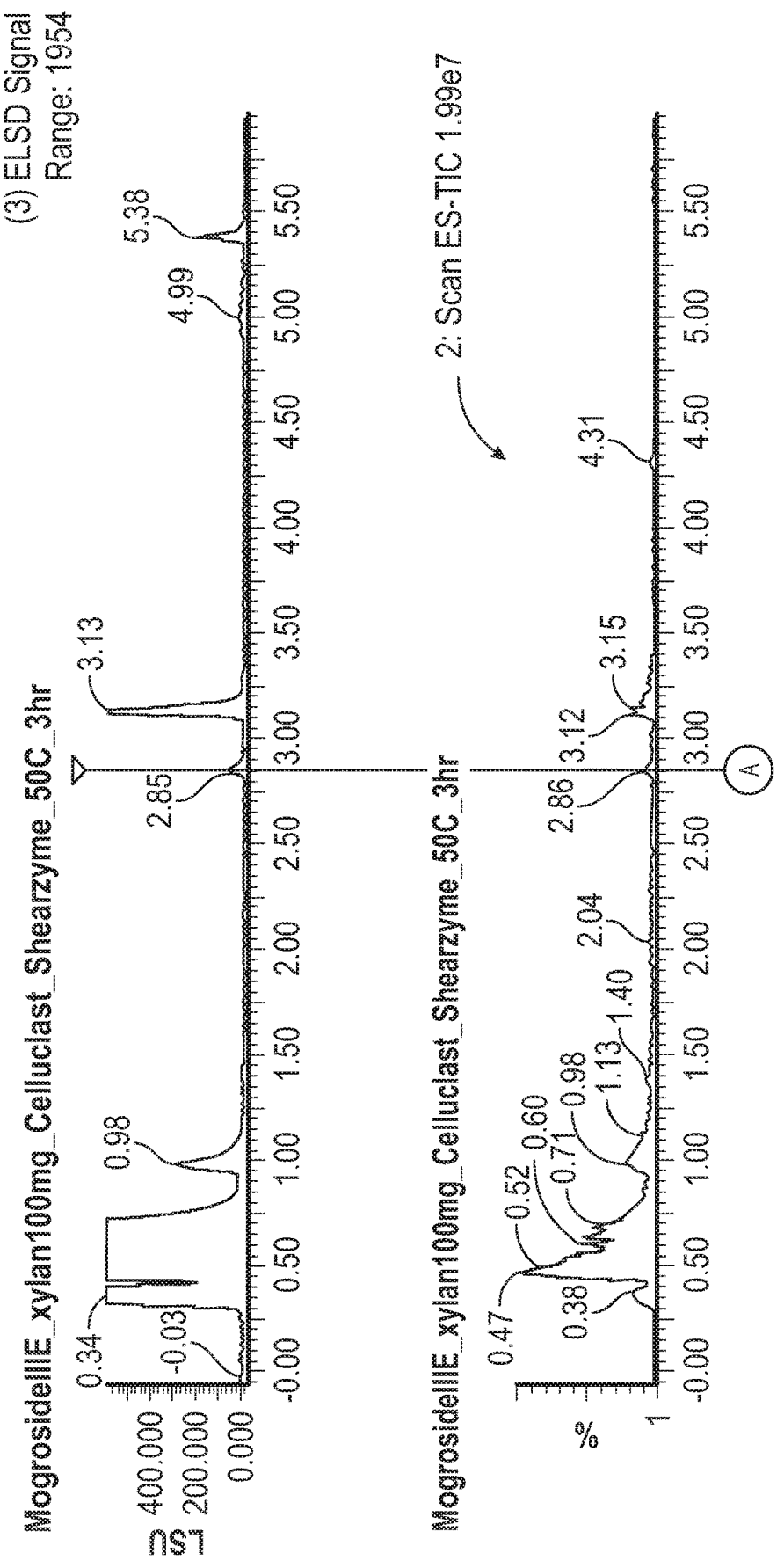
FIG. 3 shows HPLC data and mass spectroscopy data (inset) of mogroside glycosylation reaction after treatment with Celluclast in the presence of xylan.
Figure 3:
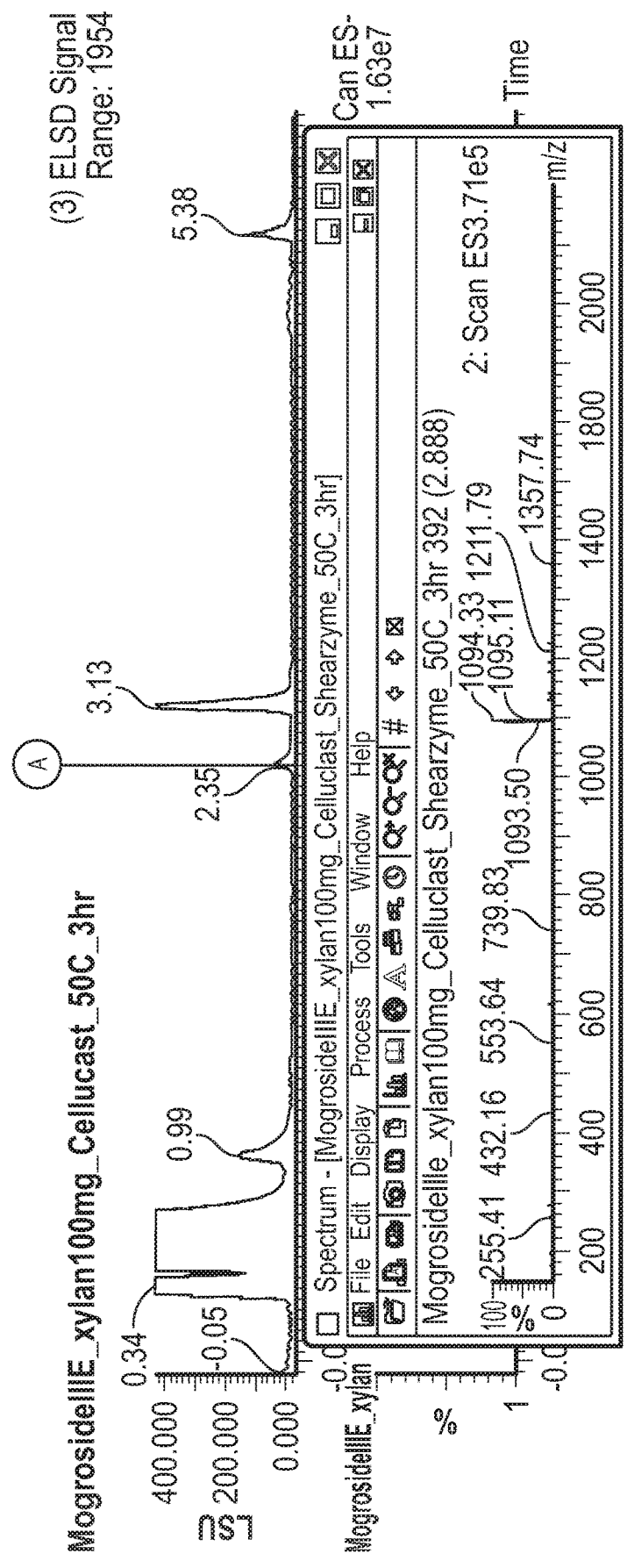

Xylosylated product is highlighted in FIG. 3. Products from xylosylation can be used as intermediates in production of Compound 1. The sequences for Celluclast are disclosed herein and is used herein for the production of xylosylated products.

Example 48: Glycosyltransferases (Maltotriosyl Transferase) (Native Host: *Geobacillus* sp. APC9669)

In this example, glycosytransferase AGY15763.1 (Amano Enzyme U.S.A. Co., Ltd., Elgin, IL; SEQ ID NO: 434) was used. 20 mL dI water, 0.6 ml 0.5M MES pH 6.5, 6 g soluble starch, 150 mg Mogroside IIIE, and 3 ml enzyme were added to a 40 ml flat-bottom screw cap vial. The vial was sealed with black cap, incubated at 30° C. and stirred at 500 rpm using magnetic bar. 3 more identical reactions were set up for a total of 600 mg Mogroside IIIE used as starting material. The reaction was stopped after 24 hours. Insoluble starch was removed by centrifugation (4000 rpm for 5 min, Eppendorf). The supernatant was heated to 80° C. for 30 minutes with stirring (500 rpm), followed by centrifugation (4000 rpm for 10 min, Eppendorf). The supernatant was filtered through a 250 ml, 0.22 micron PES and checked by LC-MS (Sweet Naturals 2016-Enzymatic_2016Q4_A.SPL, line 1254) to obtain HPLC data The AGY15763.1 protein (SEQ ID NO: 434) can be encoded by the native gDNA (SEQ ID NO: 437) or codon optimized (for *E. coli*) DNA sequence (SEQ ID NO: 438)

An example of additional glycosyltransferase expected to perform similarly is the UGT76G1 protein from *Stevia rebaudiana* (SEQ ID NO: 439), which can be expressed in *E. coli*. The native coding sequence for UGT76G1 (SEQ ID NO: 439) is provided in SEQ ID NO: 440).

Example 49: UDP-Glycosyltransferases UGT73C5 in the Presence of Mogrol

Figure 4:
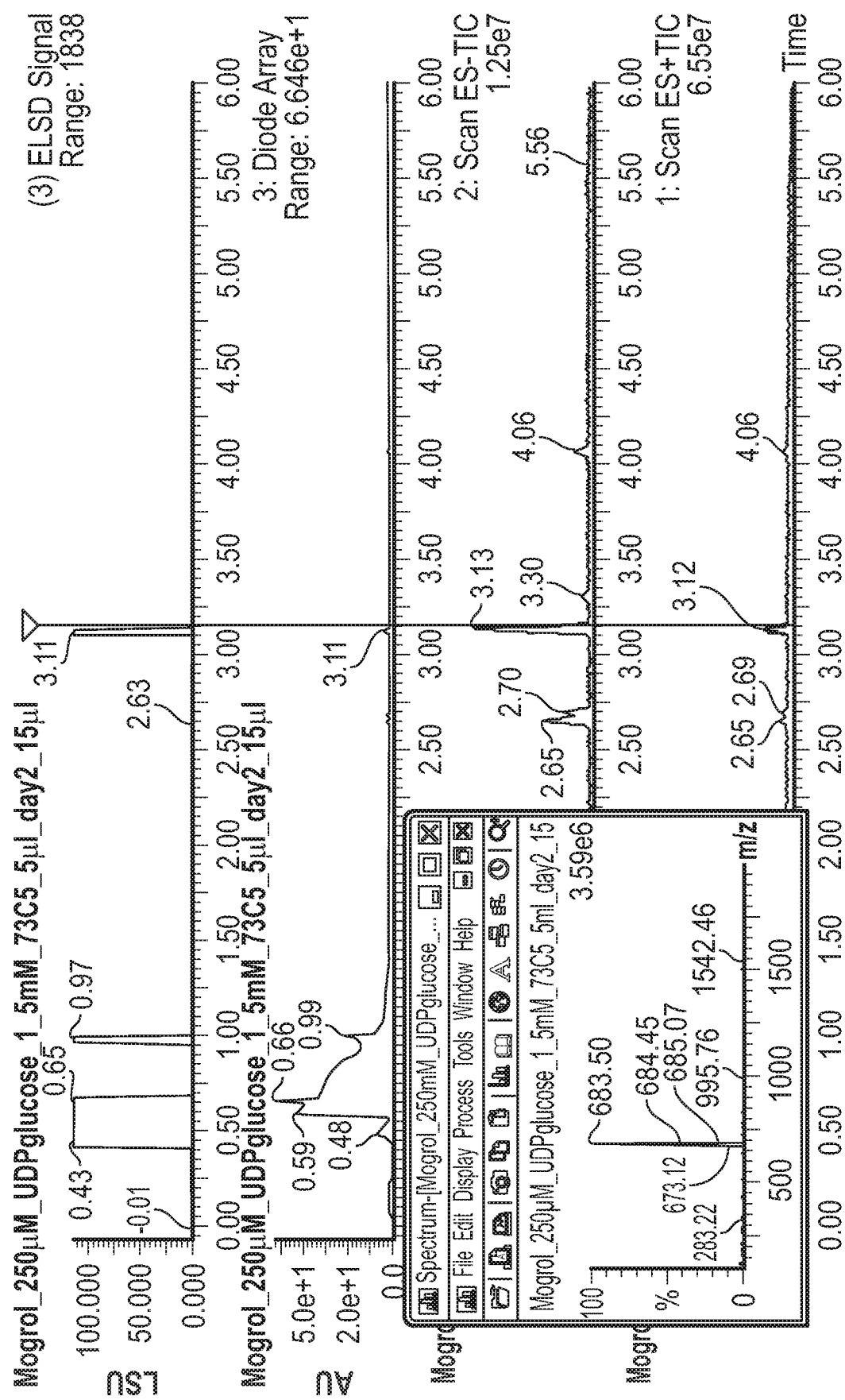
FIGS. 4 and 5 shows HPLC data and mass spectroscopy data (inset) of mogroside glycosylation reaction after treatment with UDP-glycosyltransferase.
Figure 5:
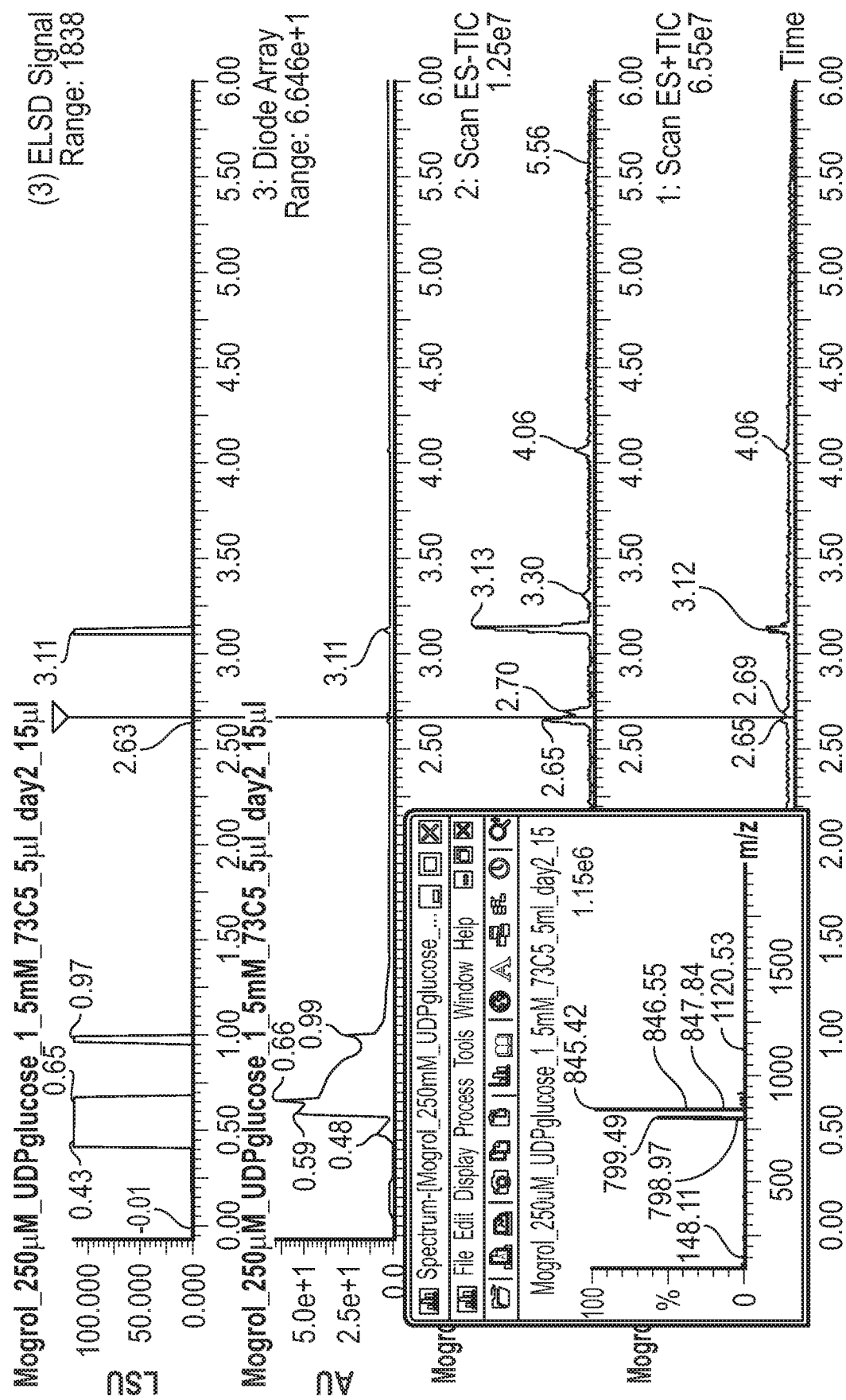

Mogrol was reacted with UDP-glycosyltransferases which produced Mogroside I and Mogroside II. 1 mg/ml of Mogrol was reacted with 200 ul crude extract containing UGT73C5 (*A. thaliana*)(334), 2 ul crude extract containing sucrose synthase, 5 mM UDP, 1×M221 protease inhibitor, 200 mM sucrose, 0.5 mg/ml spectinomycin, in 0.1M Tris-HCl pH7.0, incubated at 30 C. Samples were taken after 2 days for HPLC. The reaction products were from Mogrol to Mogroside I and Mogroside II as shown in FIGS. 4 and 5.

The protein sequence of UGT73C5 is shown in SEQ ID NO: 441, the native DNA coding sequence for UGT73C5 (SEQ ID NO: 441) is shown in SEQ ID NO: 442, and the UGT73C5 coding sequence (Codon optimized for *E. coli*) is shown in SEQ ID NO: 443.

Figure 6:
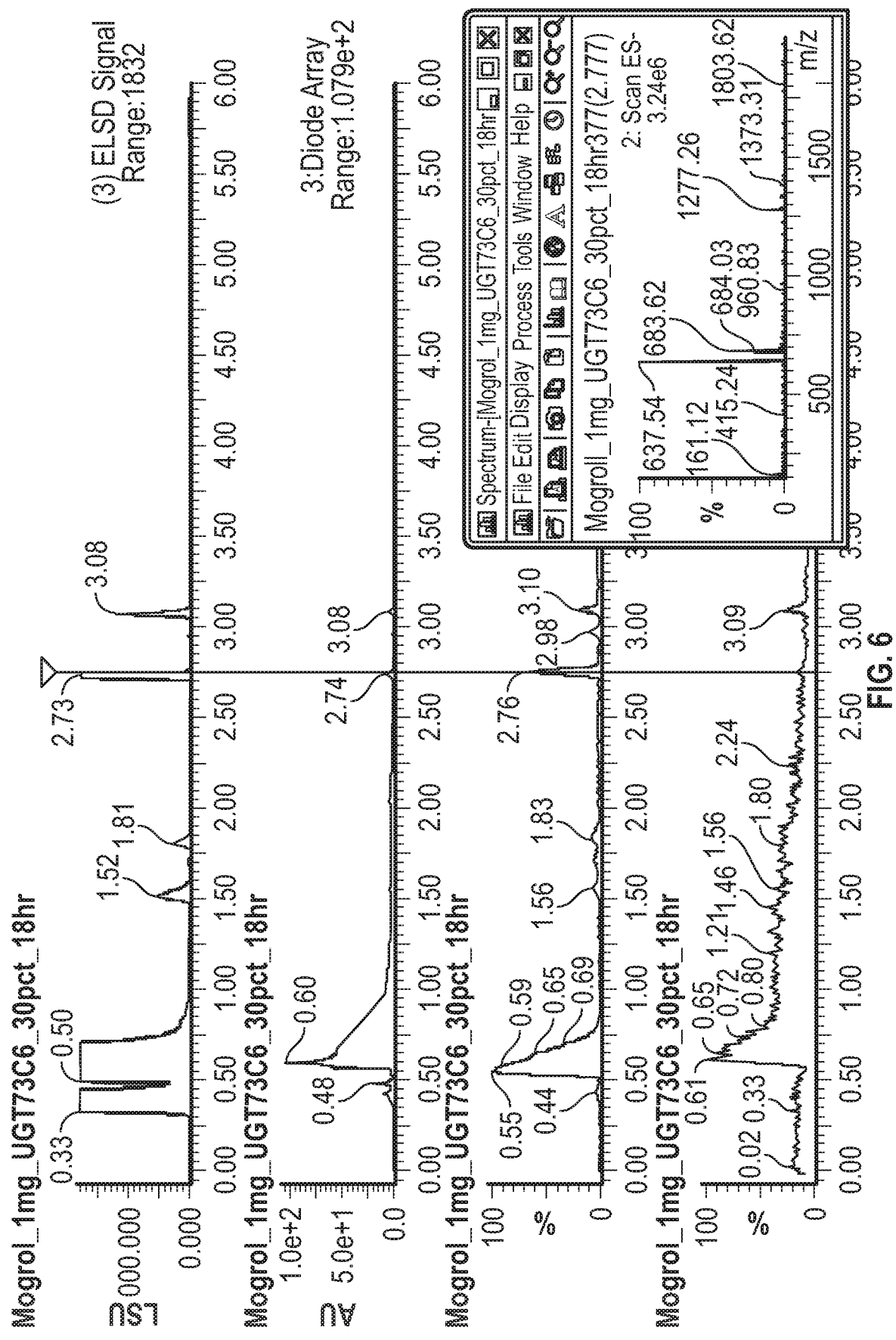
FIG. 6 shows HPLC data and mass spectroscopy data (inset) of Mogrol after treatment with UDP-glycosyltransferase UGT73C6 to Mogroside I.

Example 50: UDP-Glycosyltransferases (UGT73C6) in the Presence of Mogrol to Produce Mogroside I Reaction conditions: 1 mg/ml of Mogrol was reacted with 200 ul crude extract containing UGT73C6, 2 ul crude extract containing sucrose synthase, 5 mM UDP, 1×M221 protease inhibitor, 200 mM sucrose, 0.5 mg/ml spectinomycin, in 0.1M Tris-HCl pH7.5, incubated at 30 C. Samples were taken after 2 days for HPLC. The reaction product was Mogroside I from Mogrol. As shown in the HPLC data and Mass spectroscopy data of FIG. 6.

The protein and gDNA sequence encoding *A. thaliana* UGT73C6 is shown in SEQ ID NO: 444 and SEQ ID NO: 445, respectively.

Figure 7:
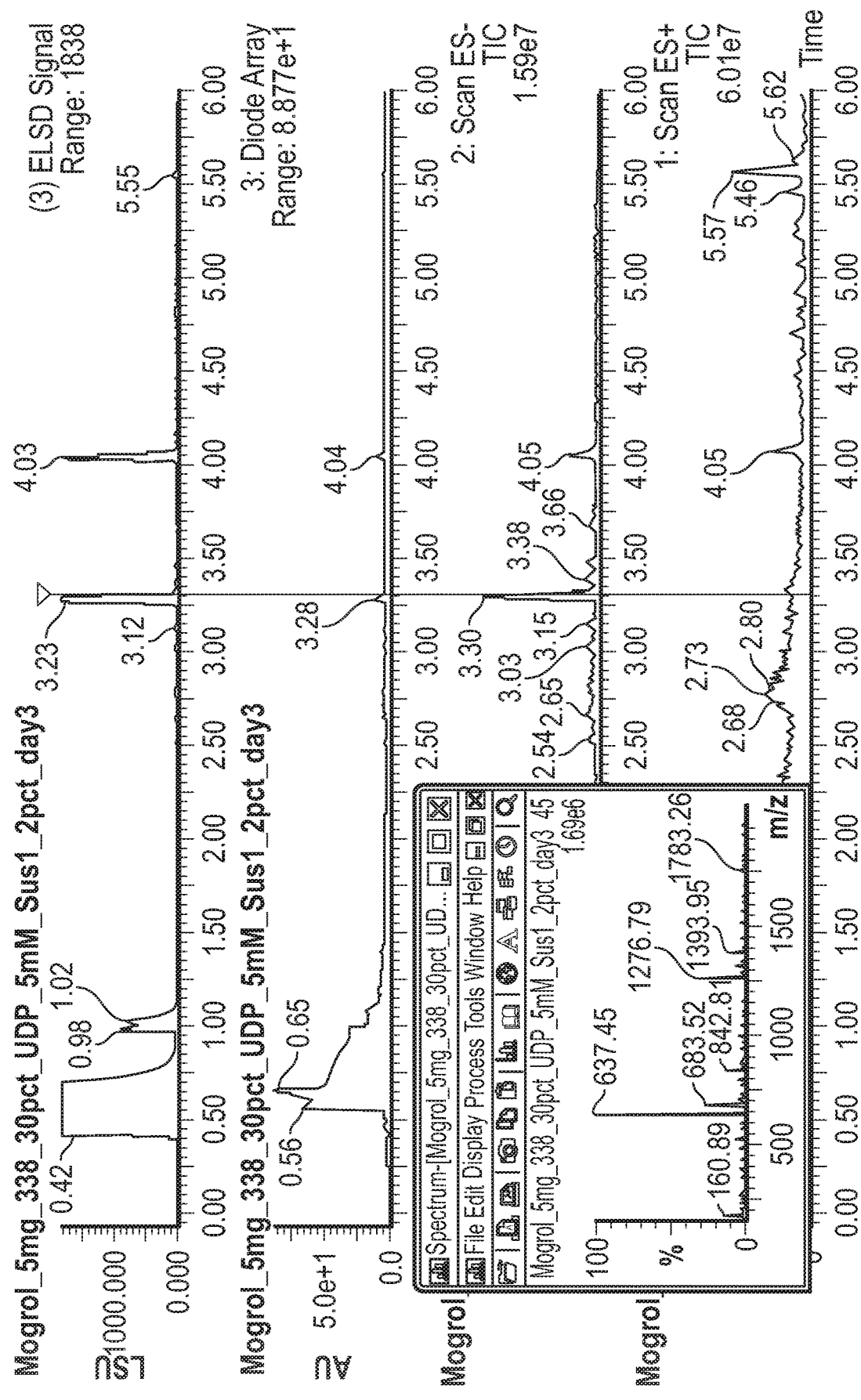
FIGS. 7-9 show HPLC data and mass spectroscopy data (inset) of Mogrol after treatment with UDP-glycosyltransferase (338) (SEQ ID NO: 405) to the products Mogroside I, Mogroside IIA, and 2 different Mogroside III products.
Figure 8:
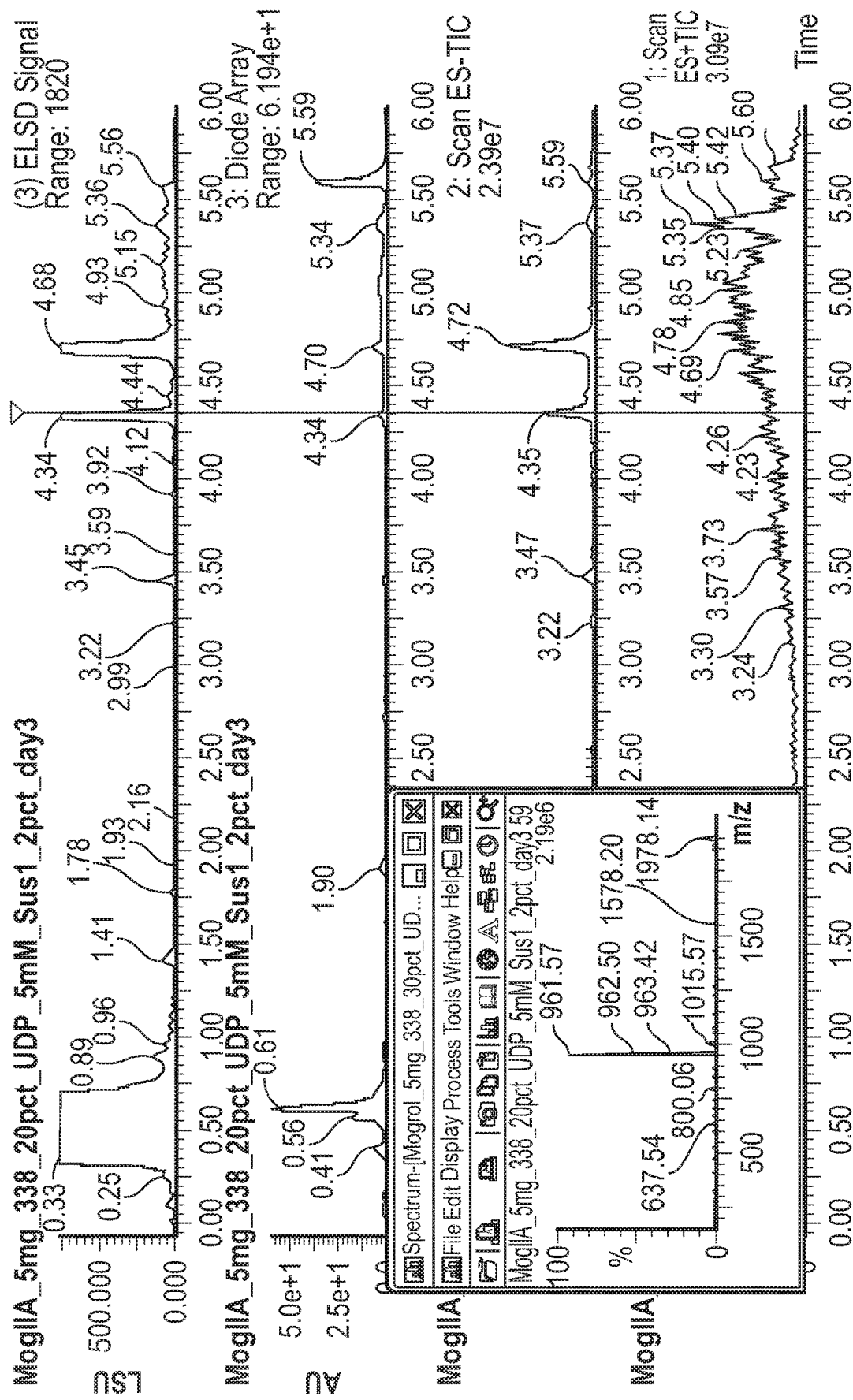
Figure 9:
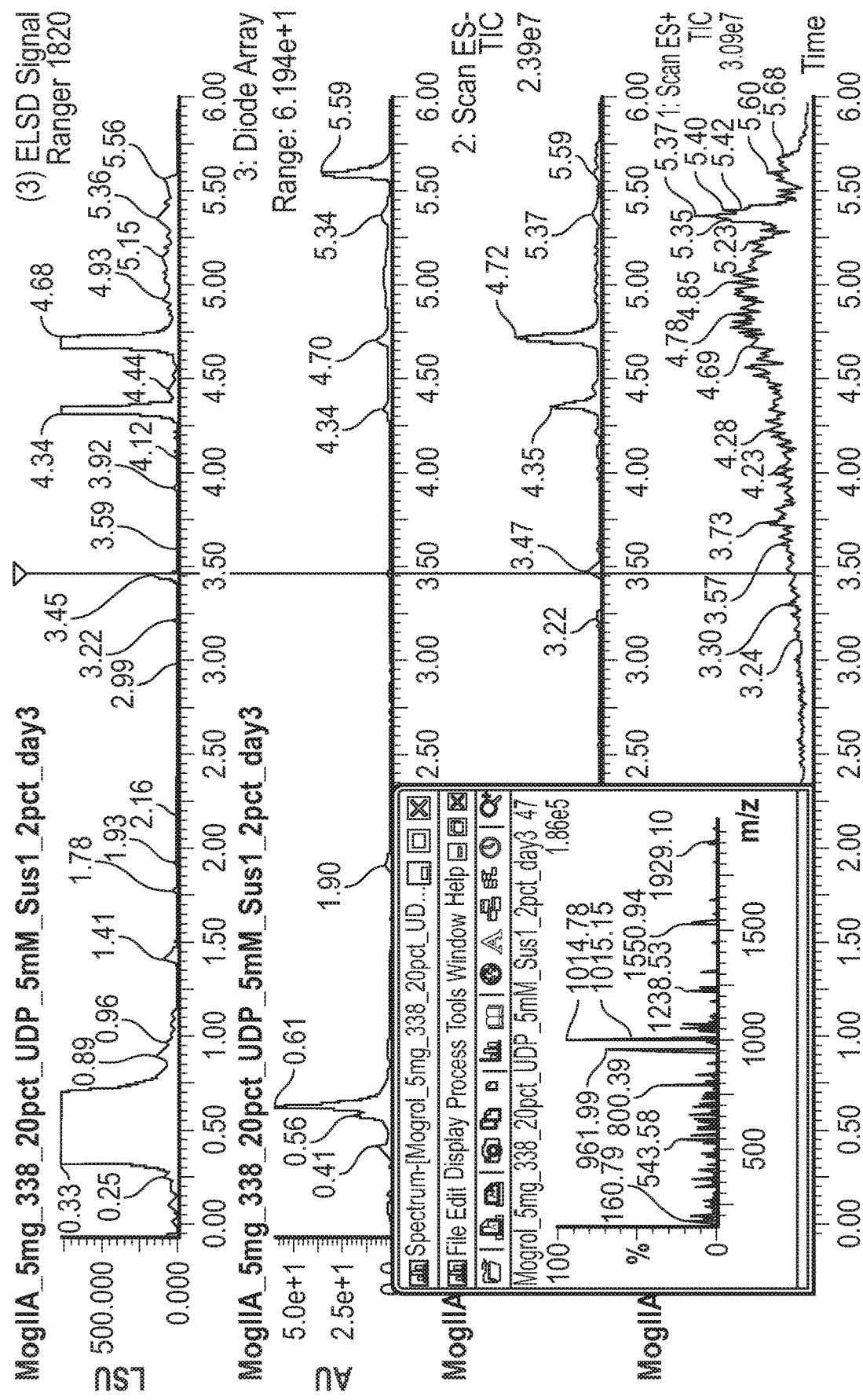

Example 51: UDP-Glycosyltransferases (338) in the Presence of Mogrol to Produce Mogroside I, Mogroside IIA and Two Different Mogroside III Products Reaction conditions: 1 mg/ml of Mogrol or Mogroside IIA was reacted with 200 ul crude extract containing 338, 2 ul crude extract containing sucrose synthase, 5 mM UDP, 1×M221 protease inhibitor, 200 mM sucrose, 0.5 mg/ml spectinomycin, in 0.1M Tris-HCl pH8.5, incubated at 30 C. Samples were taken after 2 days for HPLC Mogrol reaction with *Bacillus* sp. UDP-glycotransferase (338) (described in Pandey et al., 2014; incorporated by reference in its entirety herein) led to the reaction products: Mogroside I. Mogroside IIA, and 2 different Mogroside III products. FIGS. 7-9 show the HPLC and mass spectroscopy data for the products obtained after the reaction. FIG. 8 shows the peaks which correlate to the size of Mogrol IIA.

The protein and gDNA sequence encoding UGT 338 is provided in SEQ ID NO: 405 and SEQ ID NO: 406, respectively.

Figure 10:
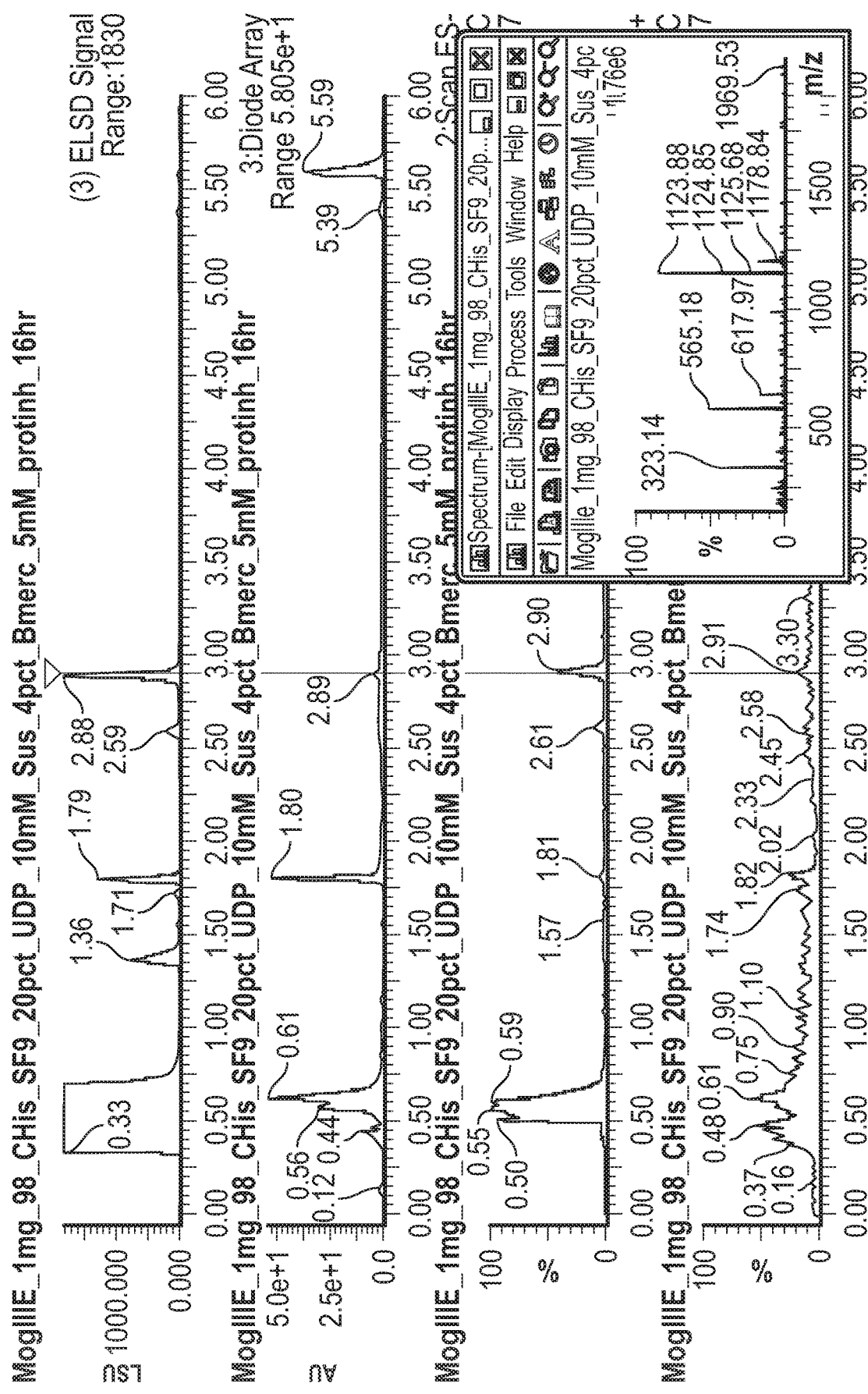
FIGS. 10 and 11 show HPLC data and mass spectroscopy data (inset) of Mogroside IIIE after treatment with UDP-glycosyltransferase to produce Siamenoside I and Mogroside V products.
Figure 11:
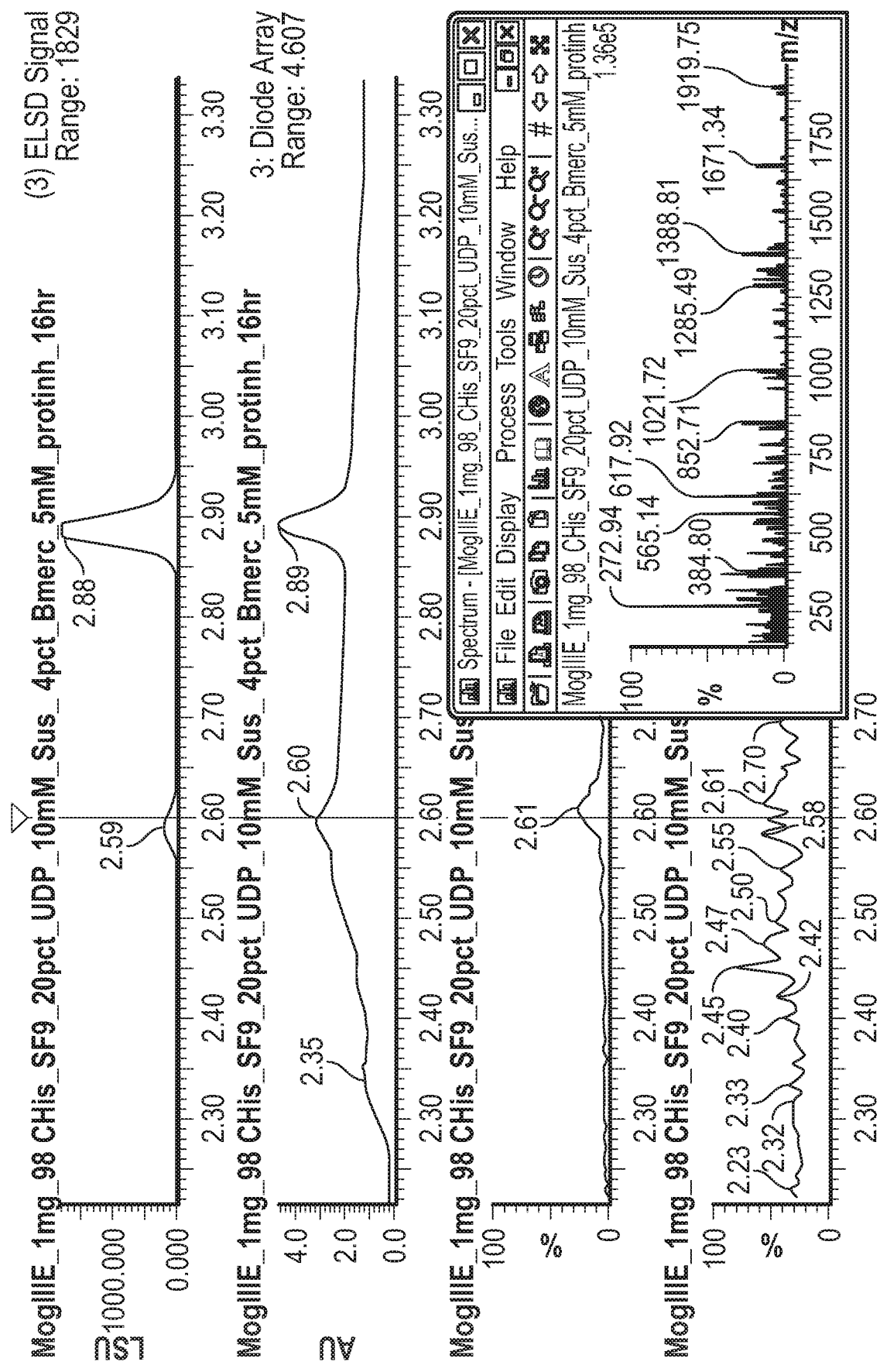

Example 52: UDP-Glycosyltransferases (301 (UGT98)) in the Presence of Mogroside IIIE to Produce Siamenoside I and Mogroside V Reaction conditions: 1 mg/ml of Mogroside IIIE was reacted with 200 ul crude extract containing 301, 2 ul crude extract containing sucrose synthase, 5 mM UDP, 1×M221 protease inhibitor, 200 mM sucrose, 0.5 mg/ml spectinomycin, in 0.1M Tris-HCl PH7.0, incubated at 30 C. Samples were taken after 2 days for HPLC and mass spec analysis. The reaction products from Mogroside IIIE were Siamenoside I and Mogroside V as shown in FIGS. 10-11.

The protein and gDNA sequence encoding *S. grosvenorii* 301 UGT98 is provided in SEQ ID NO: 407 and SEQ ID NO: 408, respectively.

Example 53: UDP-Glycosyltransferases (339) in the Presence of Mogrol, Siamenoside I or Compound 1 to Produce Mogroside I from Mogrol, Isomogroside V from Siamenoside I and Compound 1 Derivative from Compound 1

Figure 12:
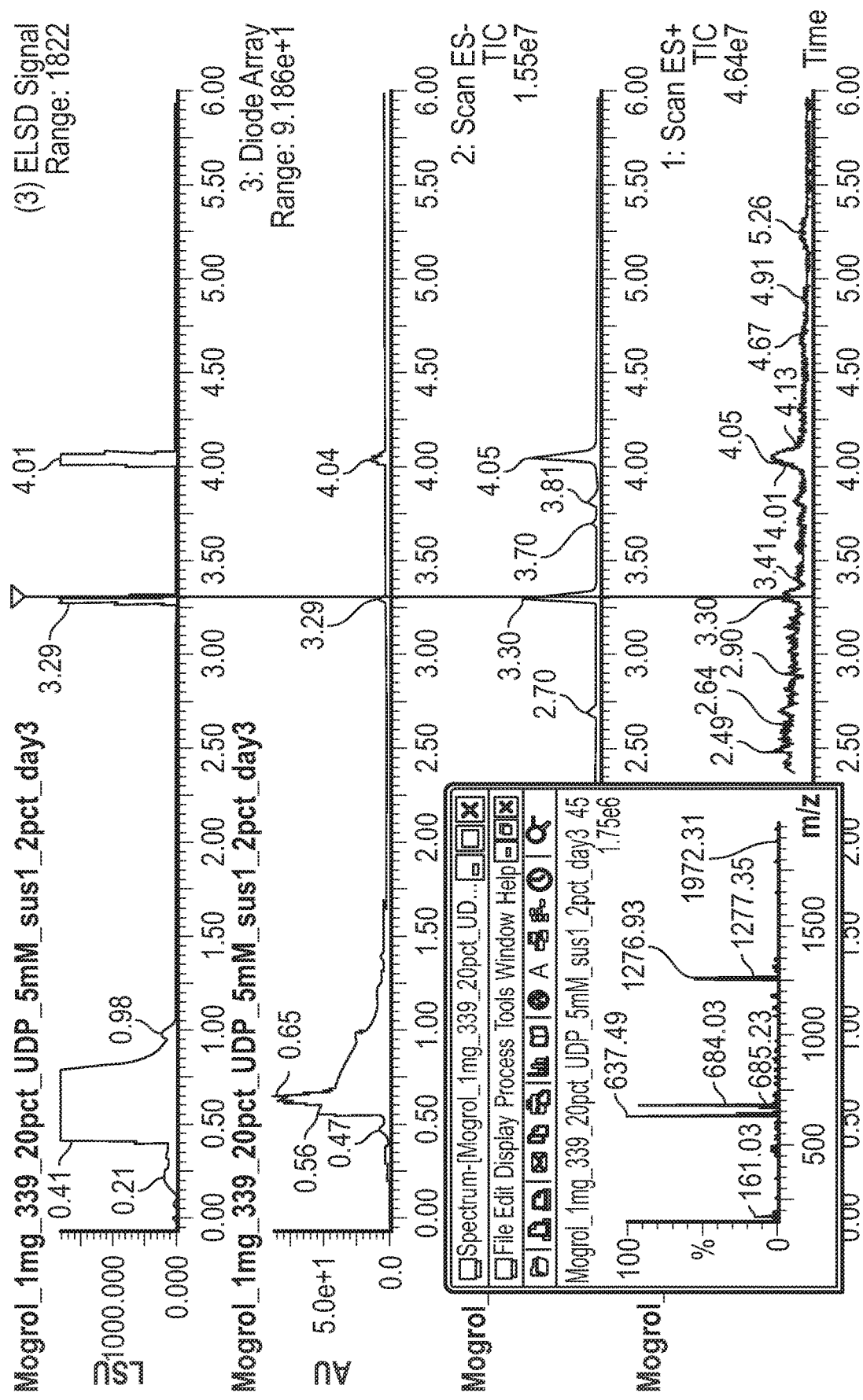
FIGS. 12-14 show HPLC data and mass spectroscopy data (inset) of products of the reaction of Mogrol, Siamenoside I or Compound 1 after treatment with UDP-glycosyltransferase (339) (SEQ ID NO:409) to produce Mogroside I, Isomogroside V and Compound 1 derivative, respectively.
Figure 13:
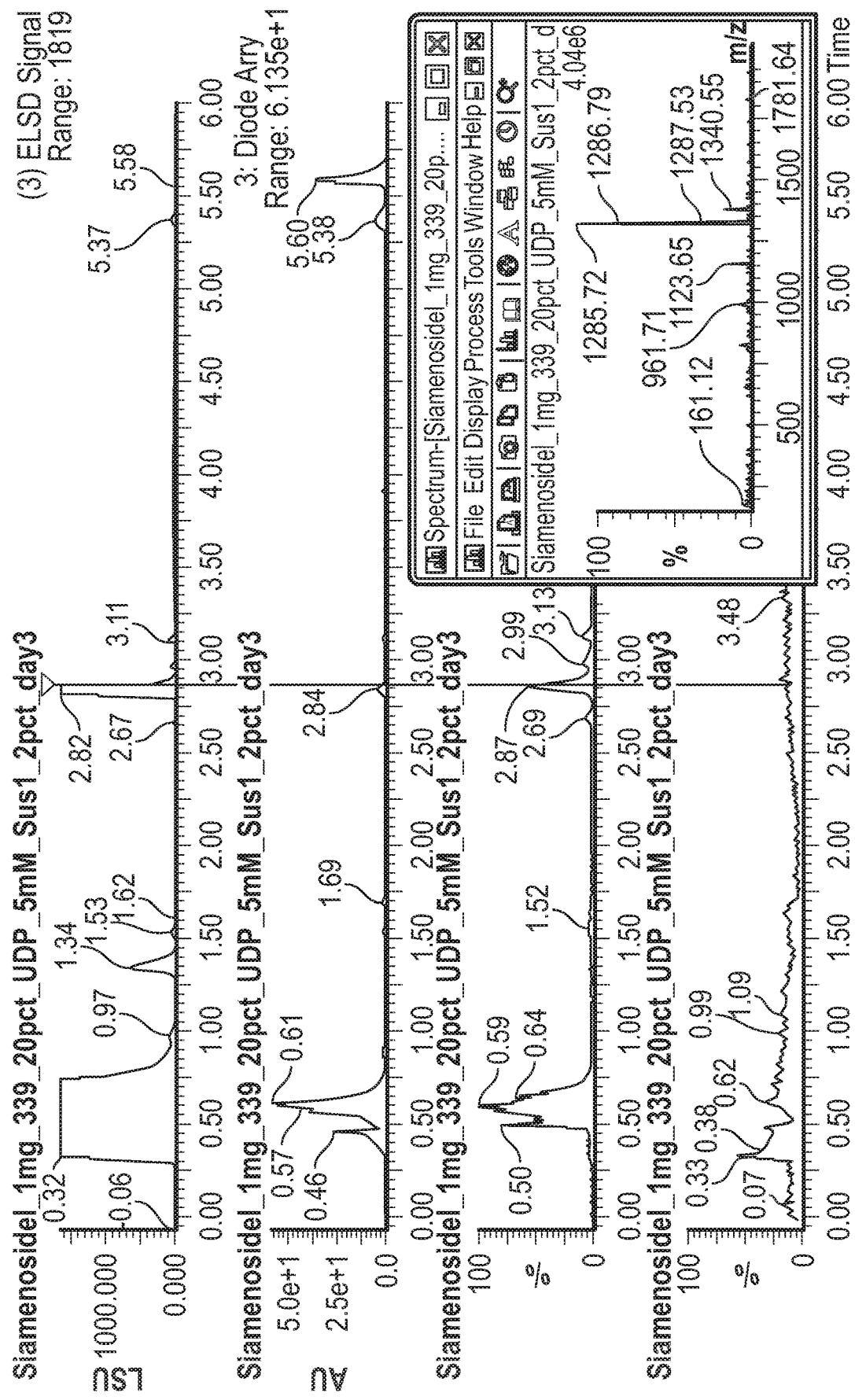
Figure 14:
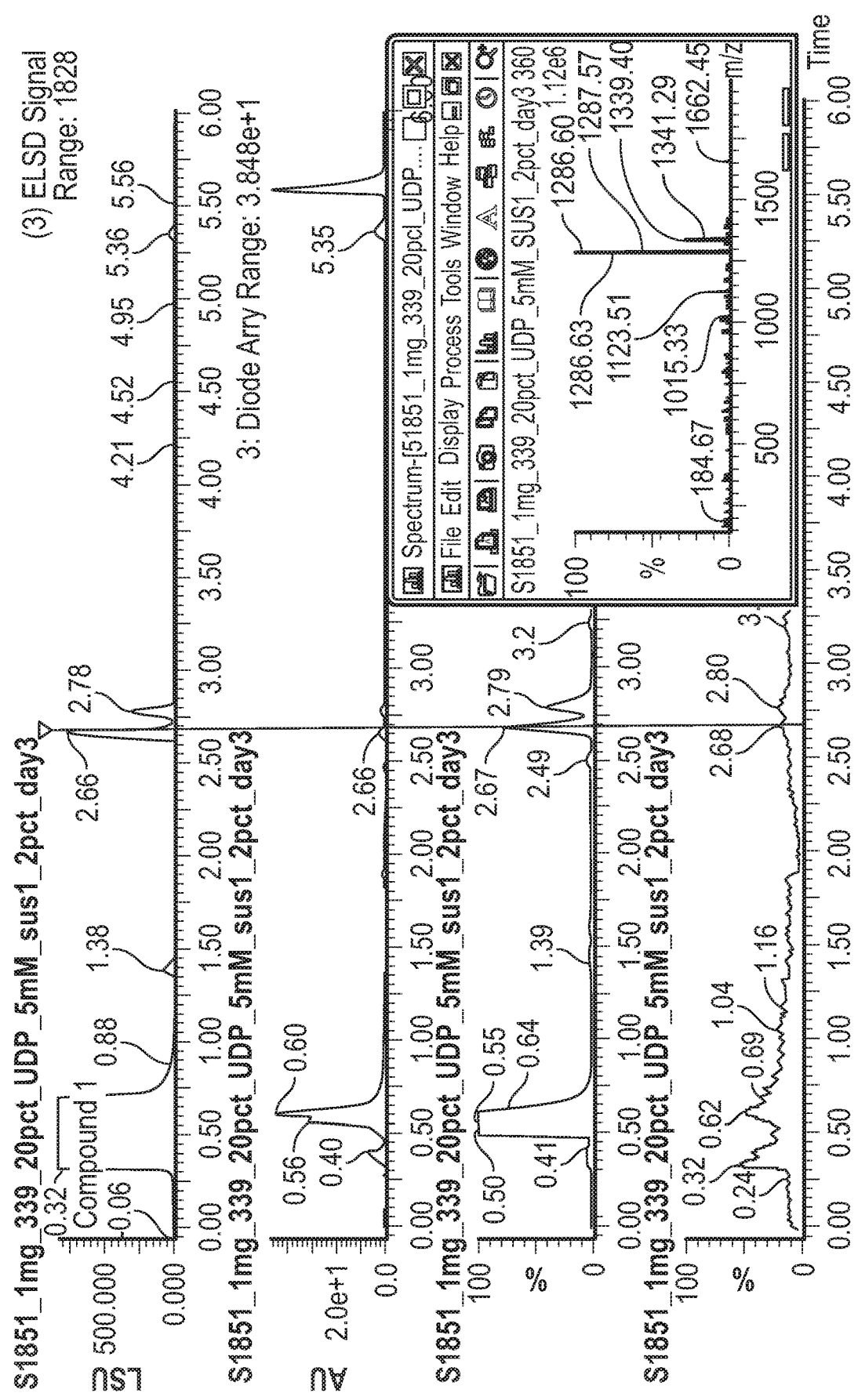
Figure 15:
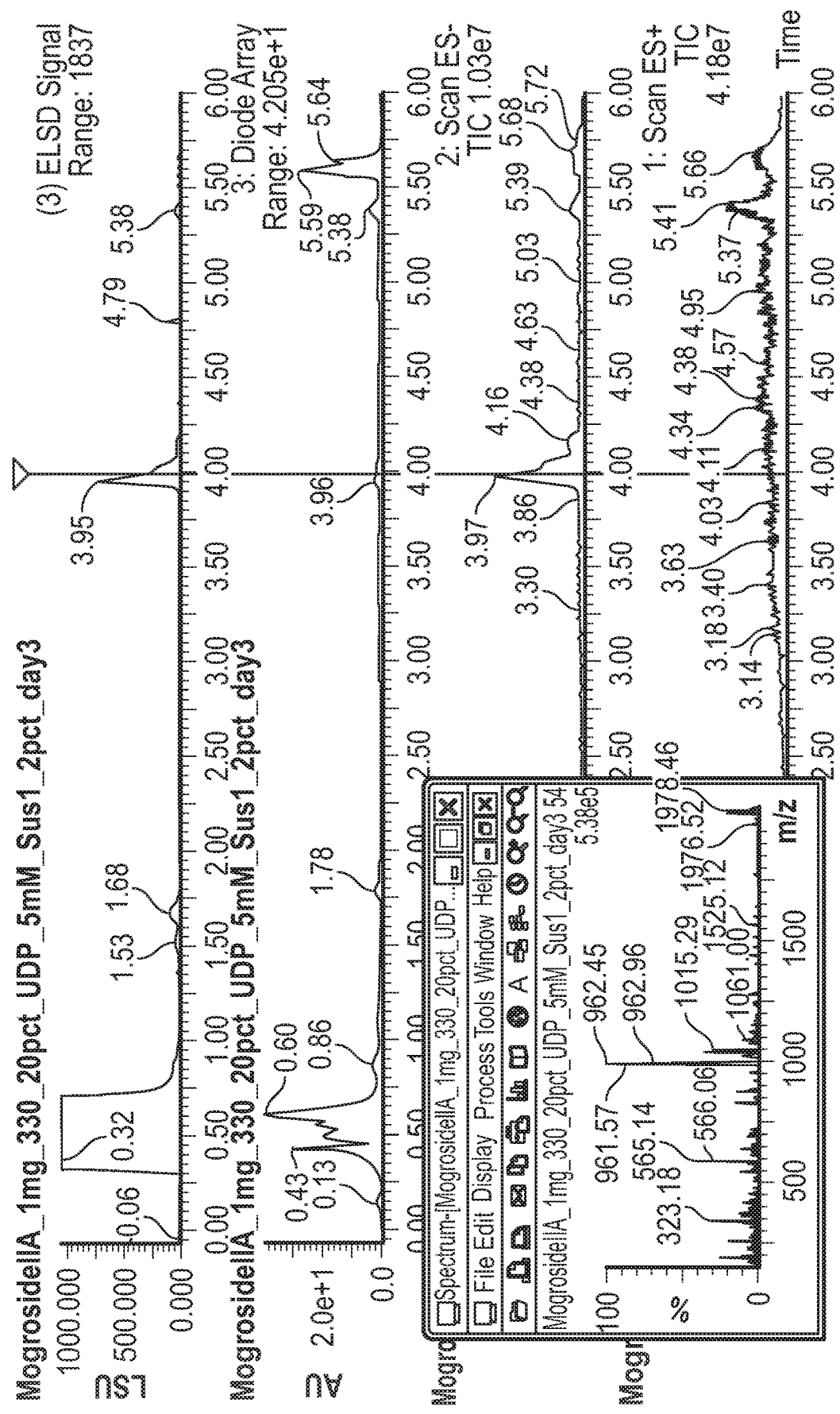
FIGS. 15-20 show HPLC data and mass spectroscopy data (inset) of Mogroside IIIA, Mogroside IVA, Mogroside V, respectively which were produced treating Mogroside IIA, Mogroside IIE, Mogroside IIIE, Mogroside IVA, or Mogroside IVE with UDP-glycosyltransferase (330) (SEQ ID NO: 411).
Figure 16:
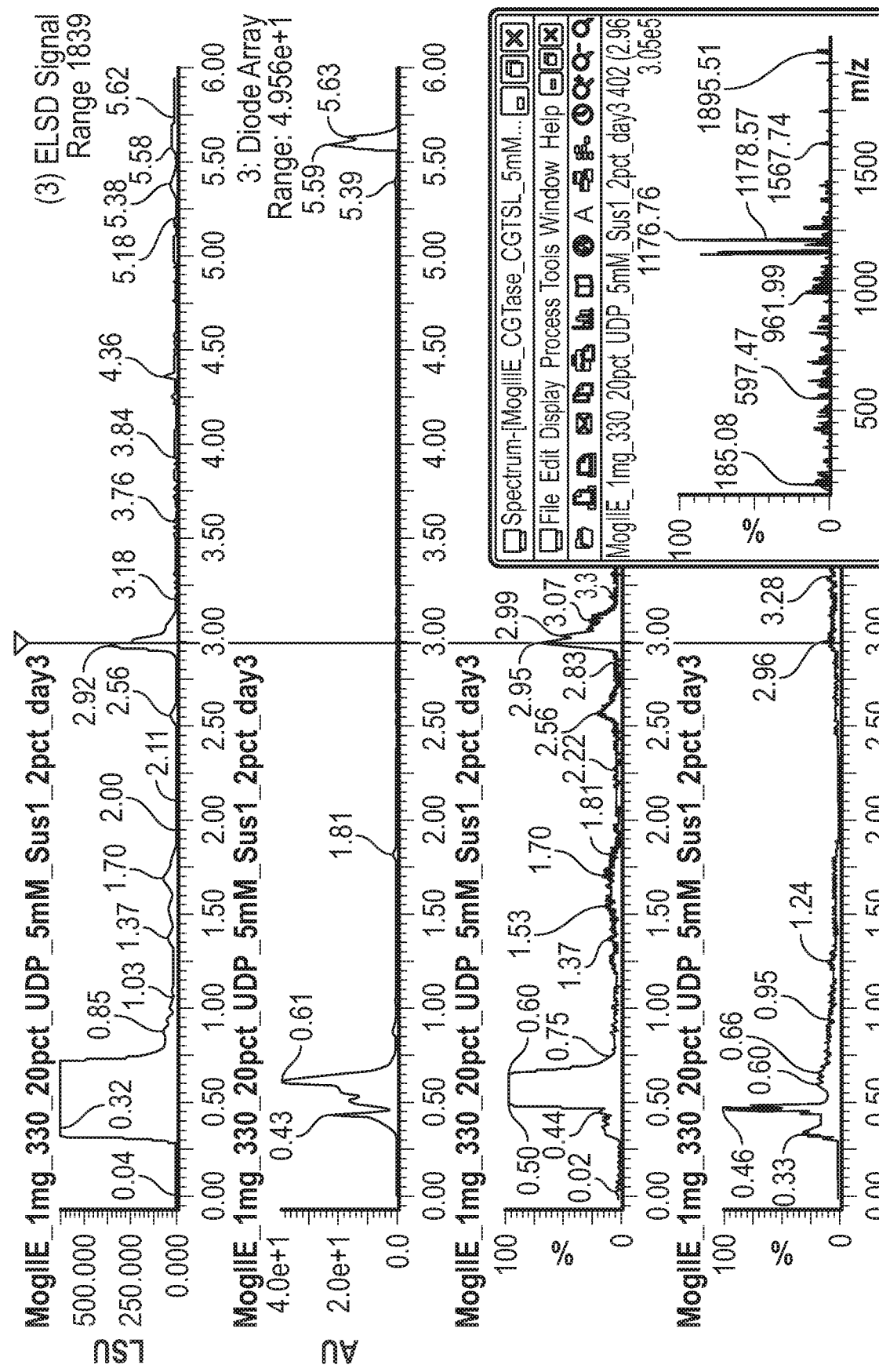
Figure 17:
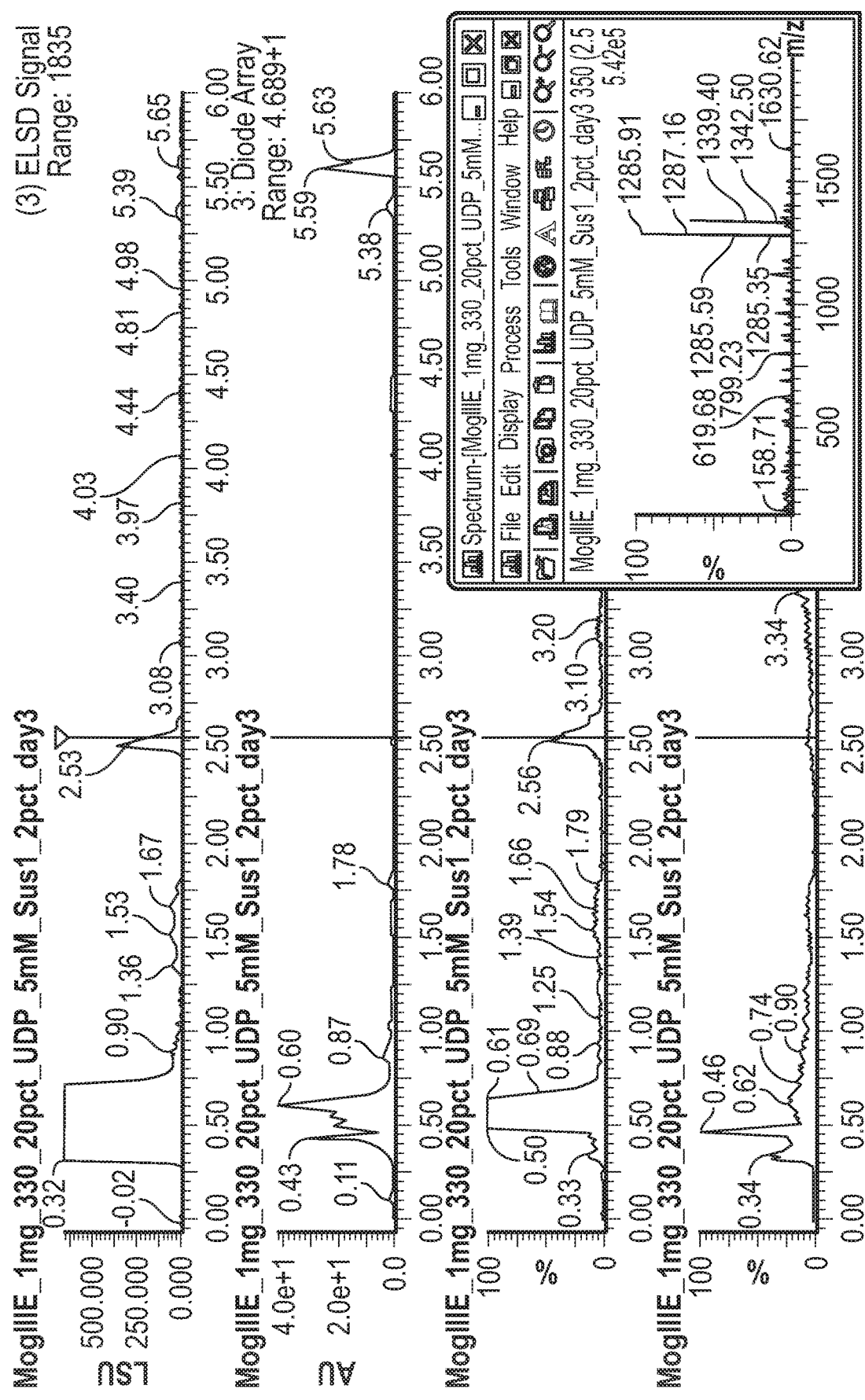
Figure 18:
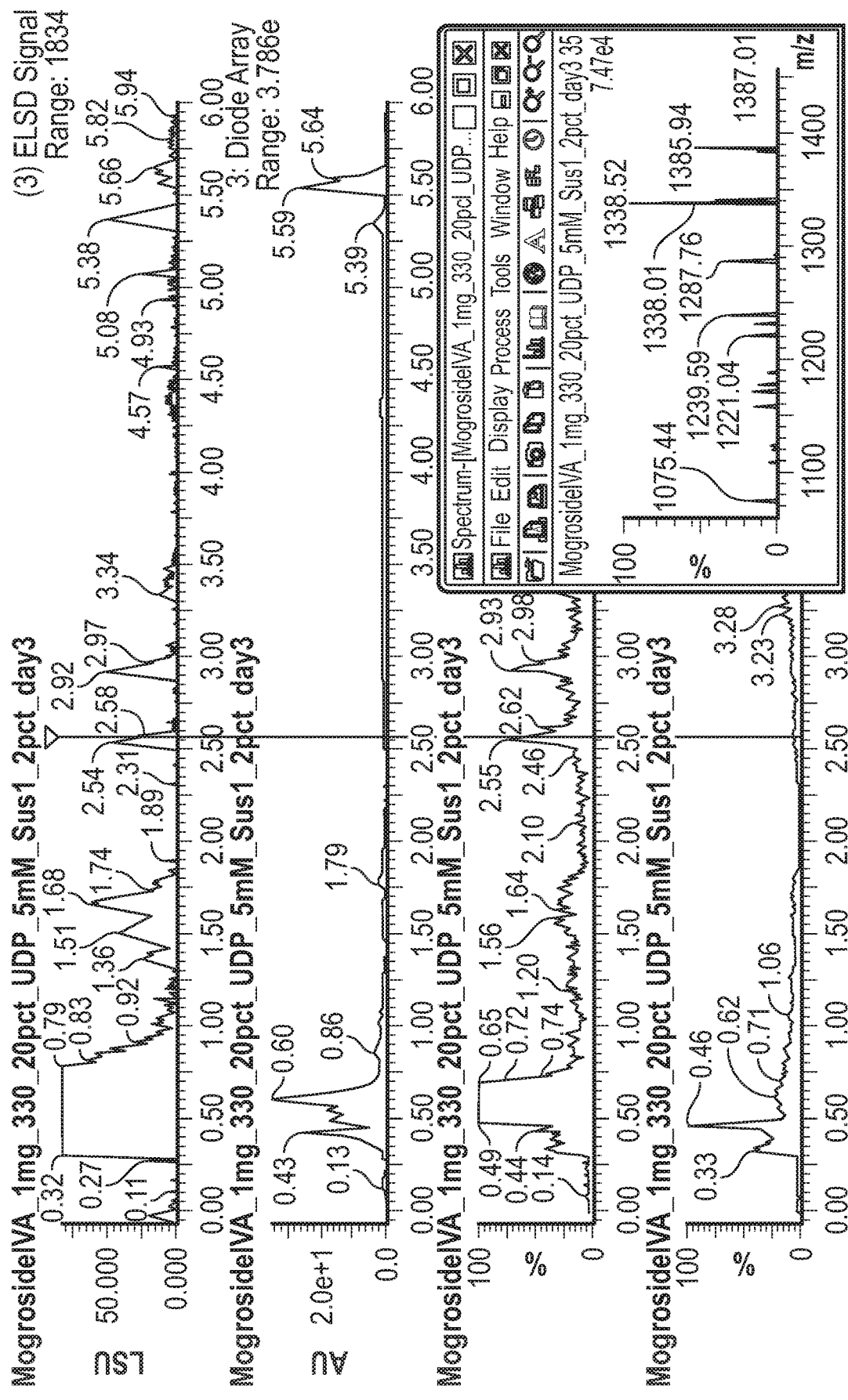
Figure 19:
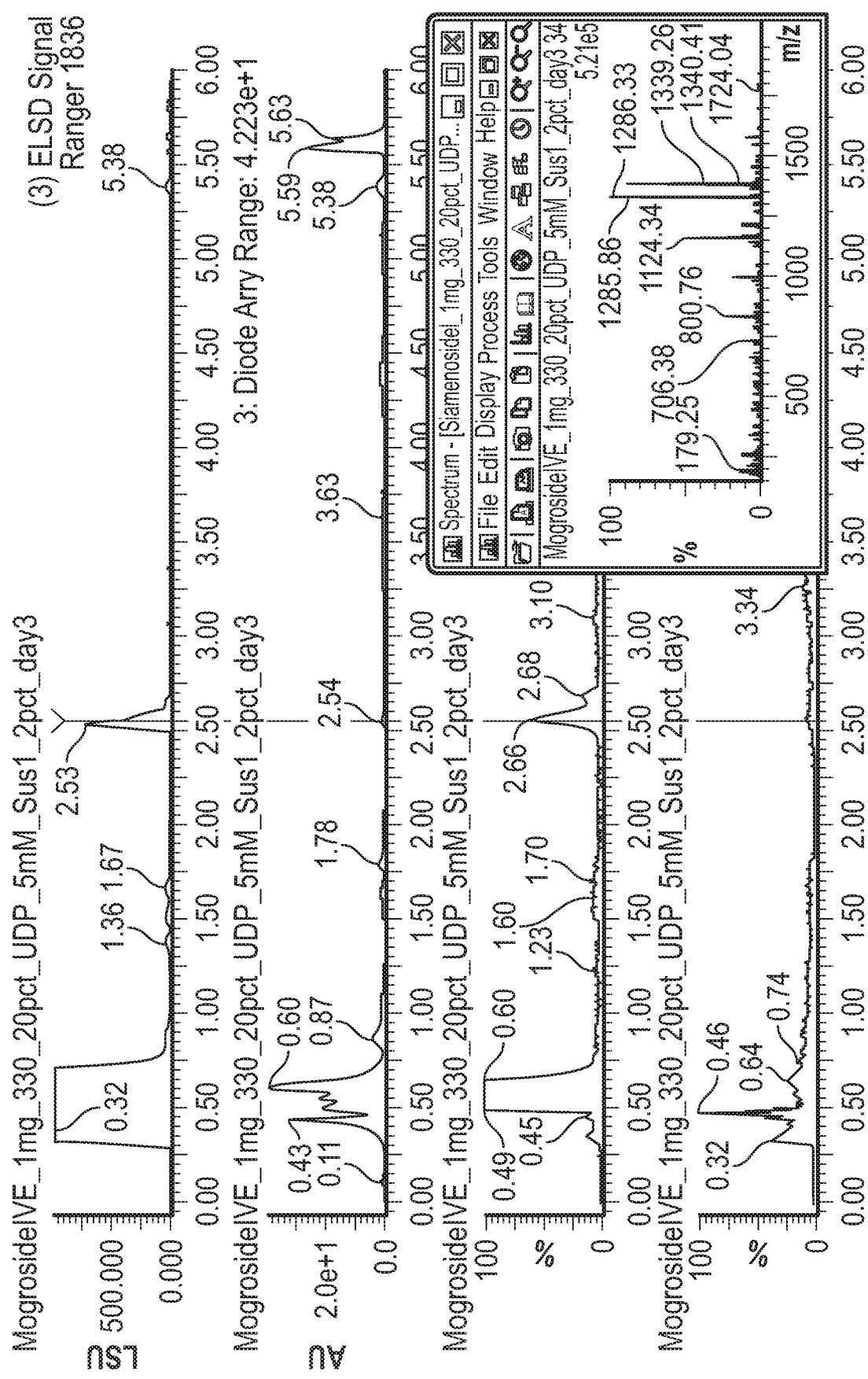
Figure 20:
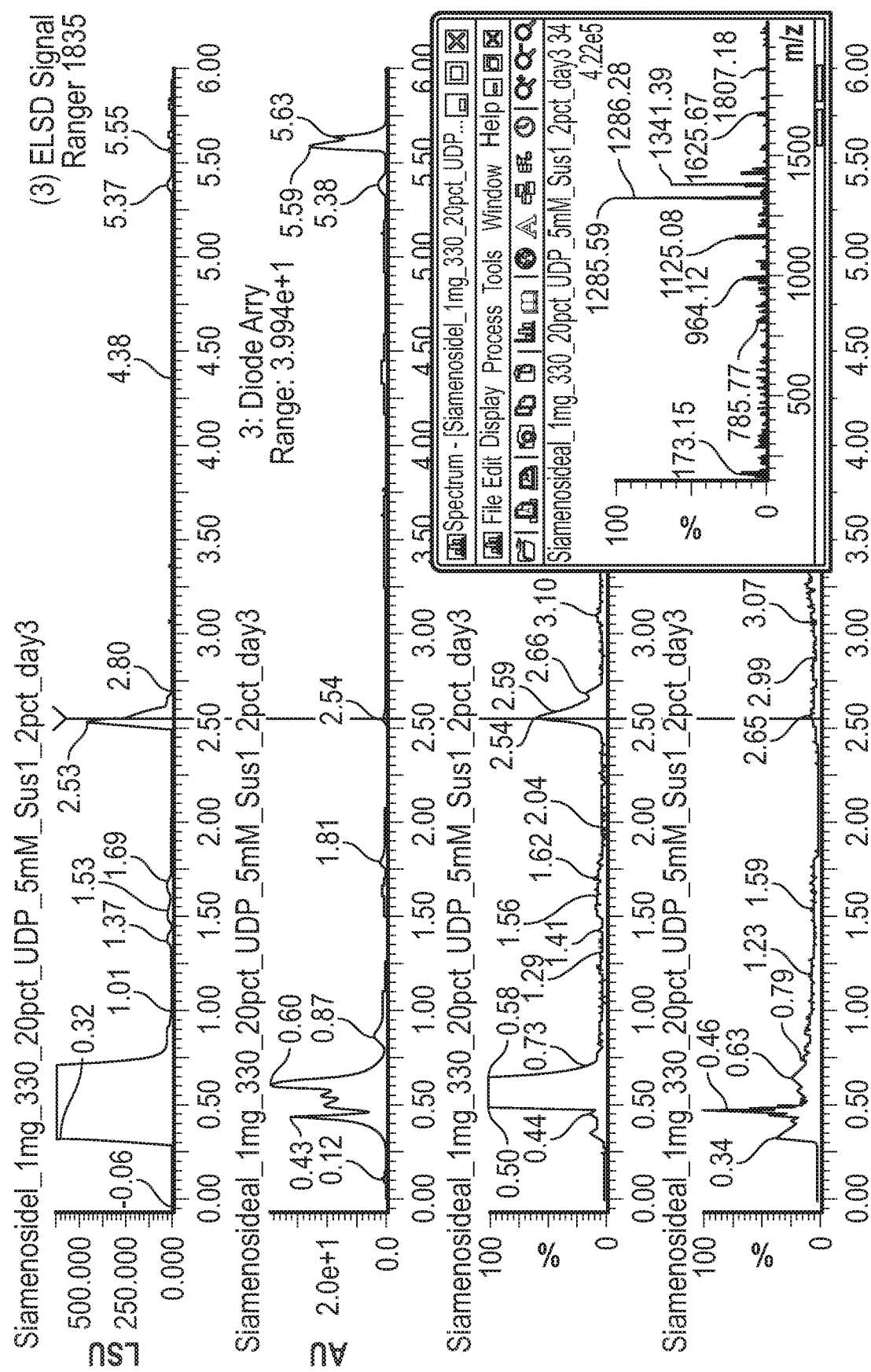

Reaction conditions: 1 mg/ml of Mogrol, Siamenoside I or Compound 1 was reacted with 200 ul crude extract containing 339 (described in Itkin et al., incorporated by reference in its entirety herein), 2 ul crude extract containing sucrose synthase, 5 mM UDP, 1×M221 protease inhibitor, 200 mM sucrose, 0.5 mg/ml spectinomycin, in 0.1M Tris-HCl pH7.0, incubated at 30 C. Samples were taken after 2 days for HPLC The reaction products from Mogrol lead to Mogroside I, Siamenoside I lead to Isomogroside V, and Compound 1 led to a Compound 1 derivative (FIGS. 12-14).

The protein and DNA sequence encoding *S. grosvenorii* UGT339 is provided in SEQ ID NO: 409 and SEQ ID NO: 410, respectively.

Example 54: UDP-Glycosyltransferases (330) in the Presence of Mogroside IIA, Mogroside IIE, Mogroside IIIE, Mogroside IVA, or Mogroside IVE to Produce Mogroside IIIA, Mogroside IVE, and Mogroside V As described herein, the use of UDP-glycotransferase (330) as described in Noguchi et al. 2008 (incorporated by reference in its entirety herein) led to the reaction products Mogroside IIIA, Mogroside IVA, Mogroside V. The native host is *Sesamum indicum*, and the production host was *E. coli*. For the reaction, 1 mg/ml of Mogroside IIA, Mogroside IIE, Mogroside IIIE, Mogroside IVA, or Mogroside IVE was reacted with 200 ul crude extract containing 330, 2 ul crude extract containing sucrose synthase, 5 mM UDP, 1×M221 protease inhibitor, 200 mM sucrose, 0.5 mg/ml spectinomycin, in 0.1M Tris-HCl pH7.0, incubated at 30 C. Samples were taken after 2 days for HPLC.

The reaction led to products such as Mogroside IIIA, Mogroside IVA, Mogroside V. As shown in FIGS. 15-20, the sizes of the compounds produced correspond to Mogroside IIIA, Mogroside IVA, and Mogroside V.

The protein and gDNA sequence encoding the *S. grosvenorii* UGT330 protein is provided in SEQ ID NO: 411 and SEQ ID NO: 412, respectively.

Figure 21:
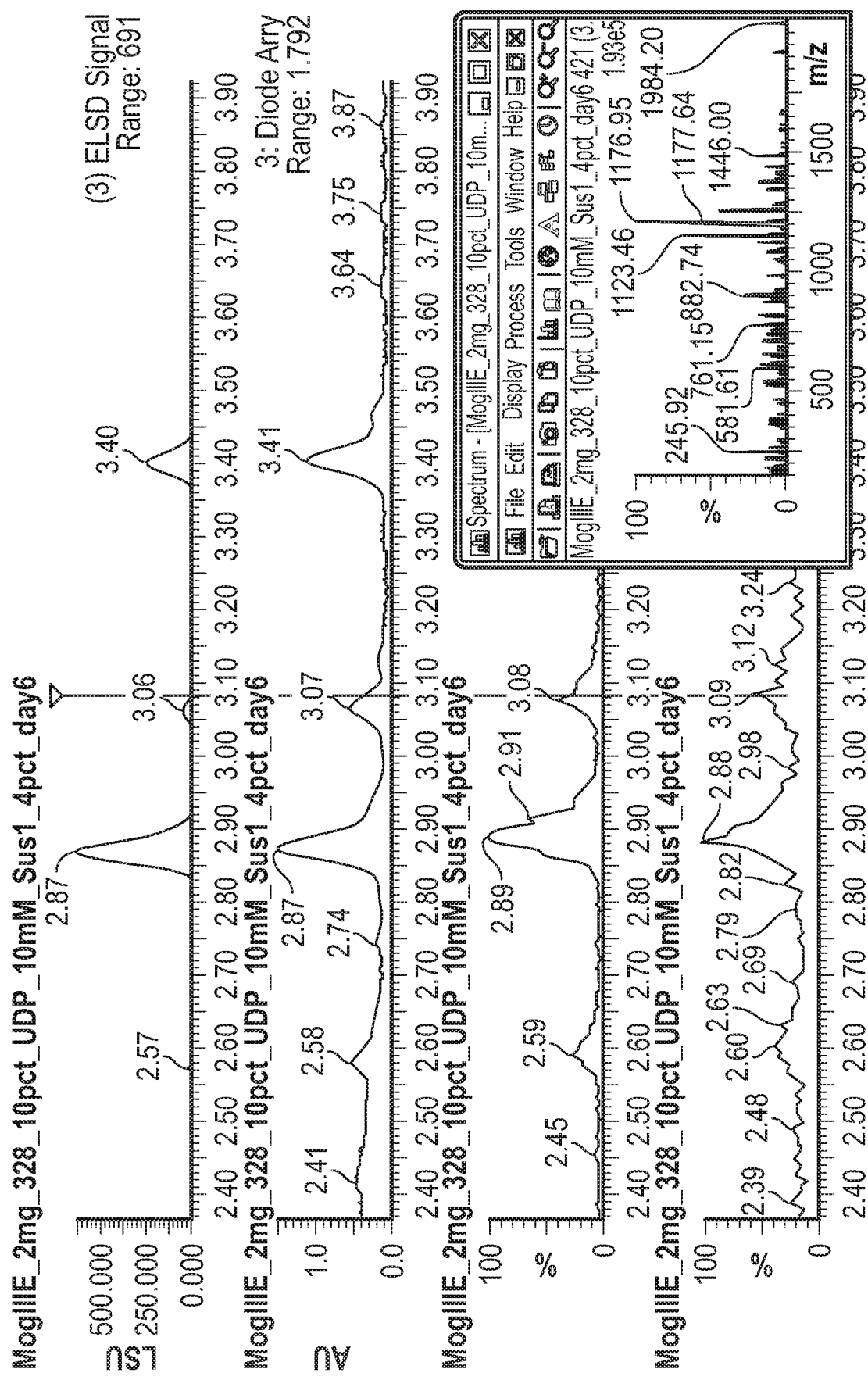
FIGS. 21 and 22 show mass spectroscopy profile of reaction products Mogroside IVE and Siamenoside I.
Figure 22:
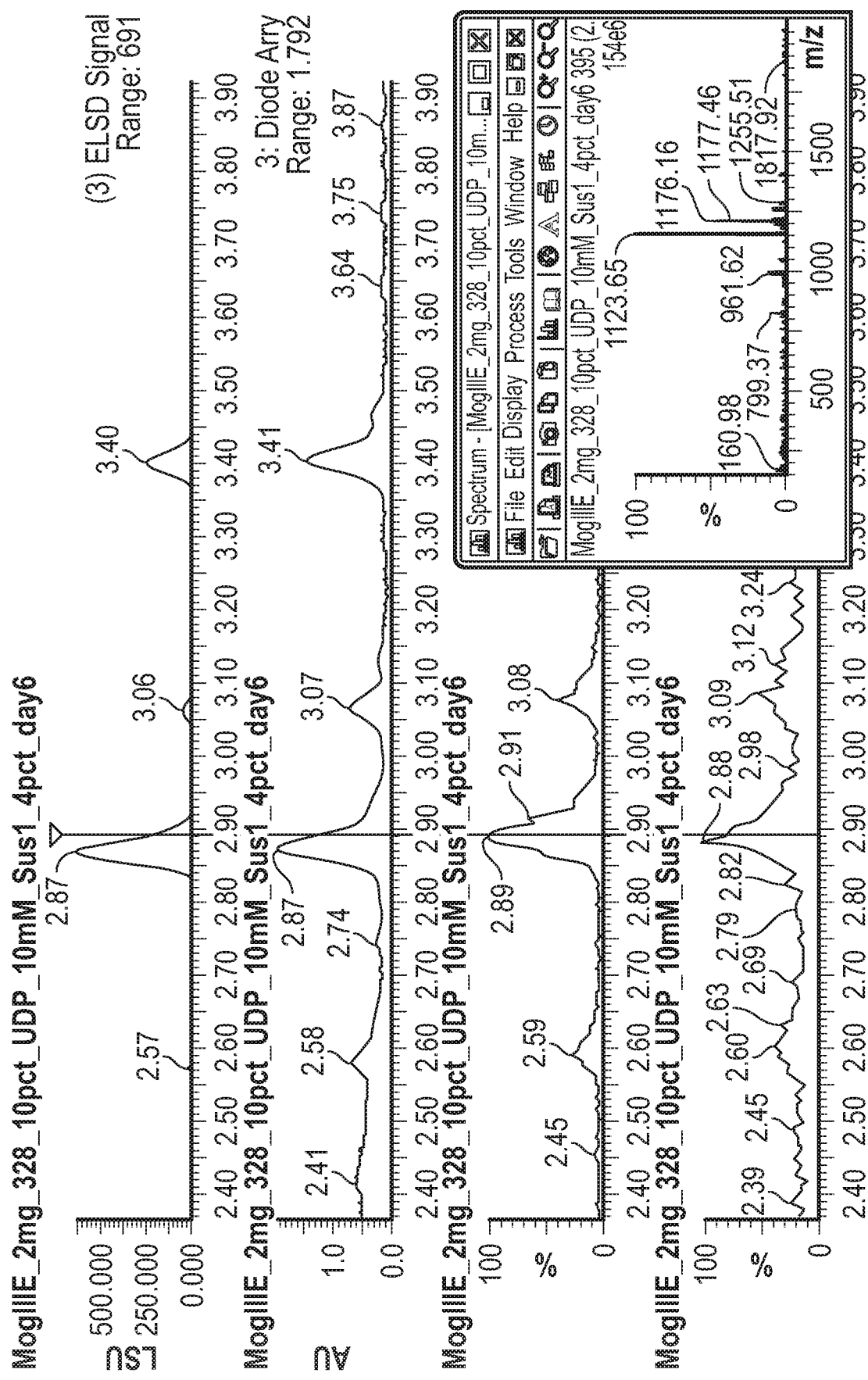

Example 55: UDP-Glycosyltransferases (328) (Described in Itkin et al) in the Presence of Mogroside IIA, Mogroside IIE, Mogroside IIIE, Mogroside IVA, or Mogroside IVE to Produce Mogroside IIIA, Mogroside IVE, and Mogroside V Reaction conditions: 1 mg/ml of Mogroside IIIE was reacted with 200 ul crude extract containing 330, 2 ul crude extract containing sucrose synthase, 5 mM UDP, 1×M221 protease inhibitor, 200 mM sucrose, 0.5 mg/ml spectinomycin, in 0.1M Tris-HCl pH7.0, incubated at 30 C. Samples were taken after 2 days for HPLC The reaction products were Mogroside IVE and Siamenoside I. As shown in FIGS. 21-22, the size of the products in the mass spectroscopy data corresponds to Mogroside IVE and Siamenoside I. *S. grosvenorii* UGT328 protein (glycosyltransferase) and coding sequence thereof is provided in SEQ ID NO: 413 and 414, respectively.

The sucrose synthase AtSus1 protein sequence and the gDNA encodes the AtSus1 protein are provided in SEQ ID NO: 415 and 416, respectively.

Example 56: Mogrol Production in Yeast

DNA was obtained through gene synthesis either through Genescript or IDT. For some of the cucurbitadienol synthases, cDNA or genomic DNA was obtained through 10-60 day old seedlings followed by PCR amplification using specific and degenerate primers. DNA was cloned through standard molecular biology techniques into one of the following overexpression vectors: pESC-Ura, pESC-His, or pESC-LEU. *Saccharomyces cerevisiae* strain YHR072 (heterozygous for erg7) was purchased from GE Dharmacon. Plasmids (pESC vectors) containing Mogrol synthesis genes were transformed/co-transformed by using Zymo Yeast Transformation Kit II. Strains were grown in standard media (YPD or SC) containing the appropriate selection with 2% glucose or 2% galactose for induction of heterologous genes at 30 C, 220 rpm. When indicated, lanosterol synthase inhibitor, Ro 48-8071 (Cayman Chemicals) was added (50 ug/ml). Yeast production of mogrol and precursors were prepared after 2 days induction, followed by lysis (Yeast Buster), ethyl acetate extraction, drying, and resuspension in methanol. Samples were analyzed through HPLC.

Production of cucurbitadienol was catalyzed by cucurbitadienol synthase *S. grosvernorii* SgCbQ in growth conditions with no inhibitor.

Figure 23:
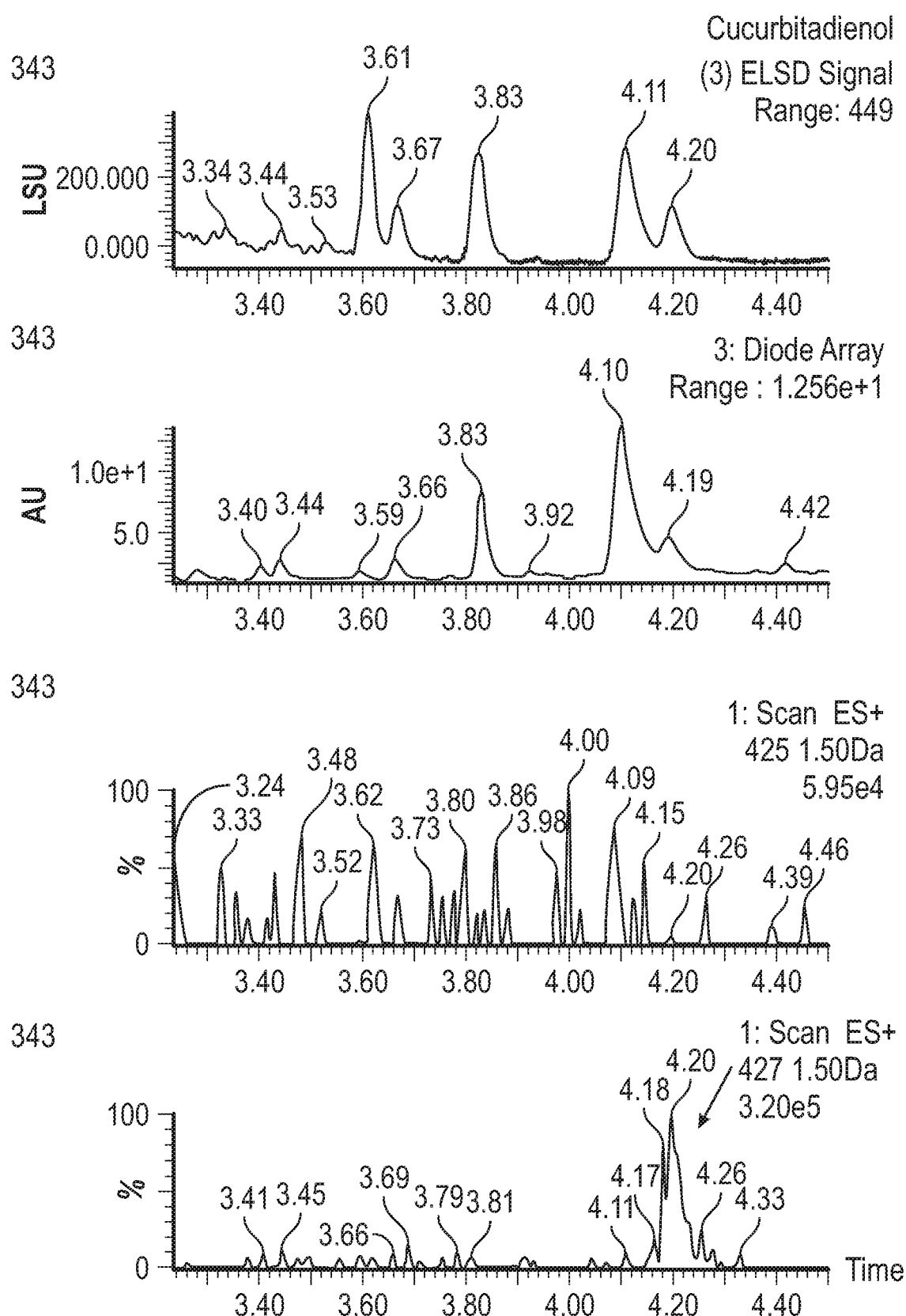
FIG. 23 shows production of cucurbitadienol with cucurbitadienol synthase (SgCbQ) (SEQ ID NO: 417).

Production of cucurbitadienol is shown in the HPLC and mass spectroscopy data which show mass peaks for the indicated product (FIG. 23). The protein sequence and DNA sequence encoding *S. grosvernorii* SgCbQ are provided in SEQ ID NO: 446 and 418, respectively.

Figure 24:
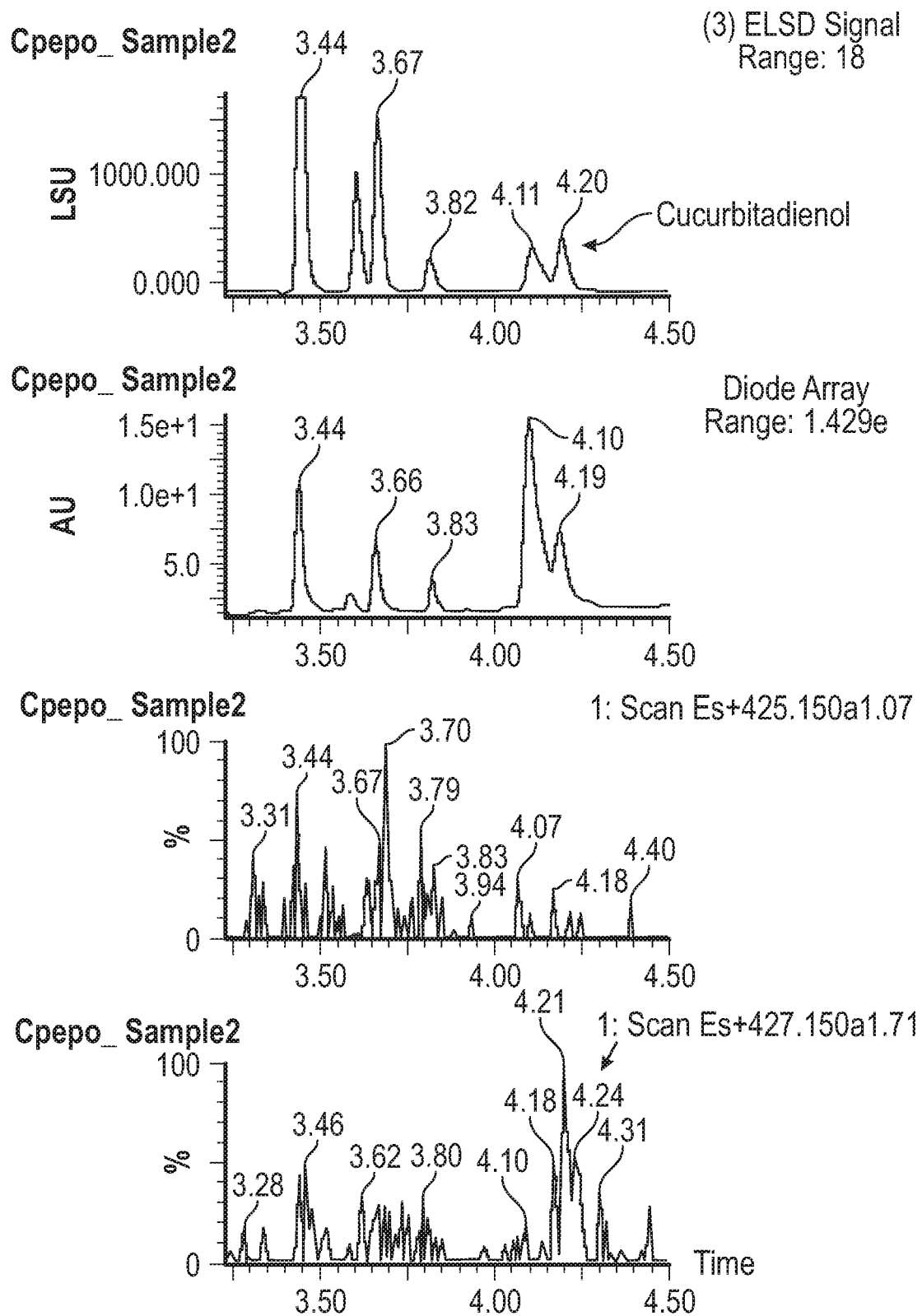
FIG. 24 shows production of cucurbitadienol using the enzyme Cpep2 (SEQ ID NO: 420).

Cpep2 was also used for the production of cucurbitadienol in yeast. As shown in FIG. 24, is the mass spectroscopy profile which shows peaks and characteristic fragments that correspond with cucurbitadienol. Protein sequence of Cpep2 and DNA sequence encoding Cpep2 protein is provided in SEQ ID NO: 420 and 421, respectively.

Figure 25:
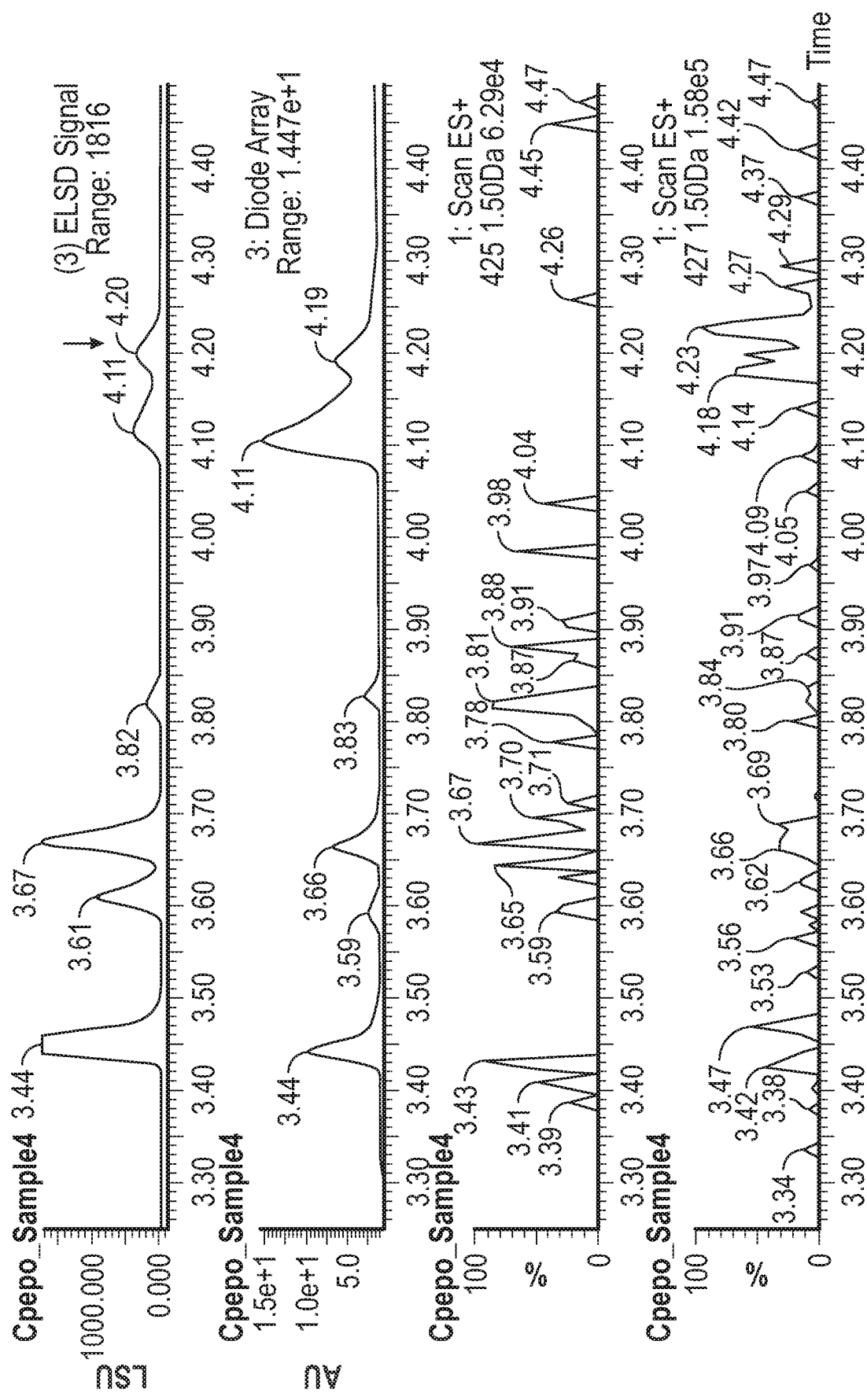
FIG. 25 shows production of cucurbitadienol using the enzyme Cpep4 (SEQ ID NO: 422).

*Cucurbita pepo* (Jack O'Lantern) Cpep4 was also used in the production of cucurbitadienol under growth conditions with no inhibitor. Production of cucurbitadienol is shown in the mass spectral data shown in FIGS. 24 and 25. As shown the peaks and fragments correspond to cucurbitadienol. The protein sequence and DNA sequence encoding Cpep4 are provided in SEQ ID NOs: 422 and 423, respectively.

A putative cucurbitadienol synthase protein sequence representing Cmax was obtained from native host *Cucurbita maxima*. The deduced coding DNA sequence will be used for gene synthesis and expression. The cucurbitadienol synthase sequences for the protein and DNA encoding the cucurbitadienol synthase is shown below:

Proteins and DNA coding sequences below were obtained through alignment of genomic DNA PCR product sequence with known cucurbitadienol synthase sequences available through public databases (Pubmed). It is expected that any one of these Cmax proteins may be used in the methods, systems, compositions (e.g., host cells) disclosed herein to produce Compound 1. A non-limiting exemplary Cmax protein is Cmax1 (protein) (SEQ ID NO: 424) encoded by Cmax1 (DNA) (SEQ ID NO: 425).

A putative cucurbitadienol synthase protein sequence representing Cmos1 was obtained from native host *Cucurbita moschata*. The deduced coding DNA sequence is used for gene synthesis and expression. Protein(s) and DNA coding sequence(s) shown below were obtained through alignment of genomic DNA PCR product sequence with known cucurbitadienol synthase sequences available through public databases (Pubmed). Any one of these Cmos proteins may be used in the methods, systems, compositions (e.g., host cells) disclosed herein to produce Compound 1. A non-limiting exemplary Cmos1 protein is Cmos1 (protein) (SEQ ID NO: 426) encoded by Cmos1 (DNA) (SEQ ID NO: 427).

Example 57: Production of Dihydroxycucurbitadienol in Yeast (Cucurbitadienol Synthase & Epoxide Hydrolase)

The production of dihydroxycucurbitadienol in yeast was considered using cucurbitadienol synthase & epoxide hydrolase. The native host for these enzymes is *S. grosvenorii*.

Growth conditions: SgCbQ was co-expressed with an epoxide hydrolase (EPH) in the presence of lanosterol synthase inhibitor.

Figure 26:
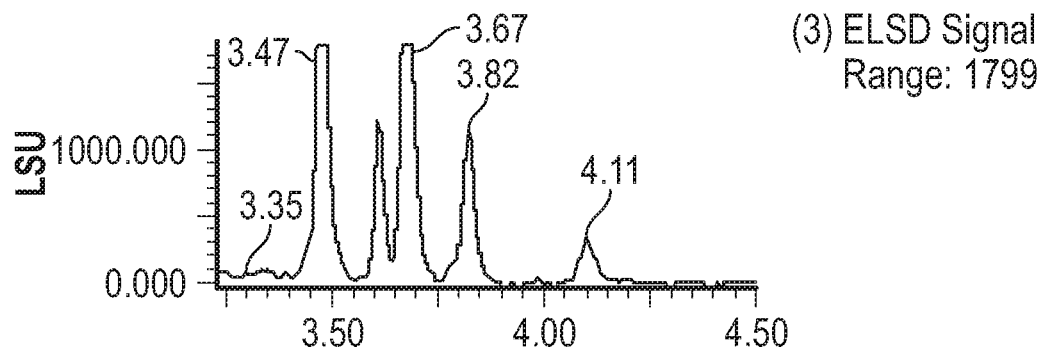
FIG. 26 shows production of dihydroxycucurbitadienol from catalysis by epoxide hydrolase (SEQ ID NO: 428).
Figure 26:
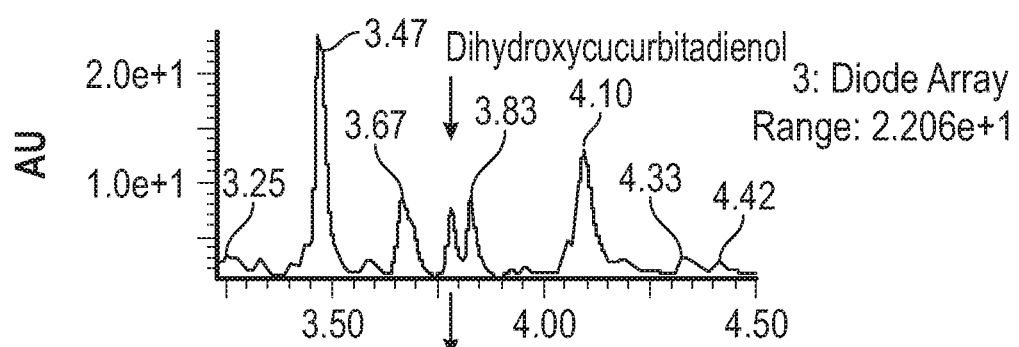
Figure 26:
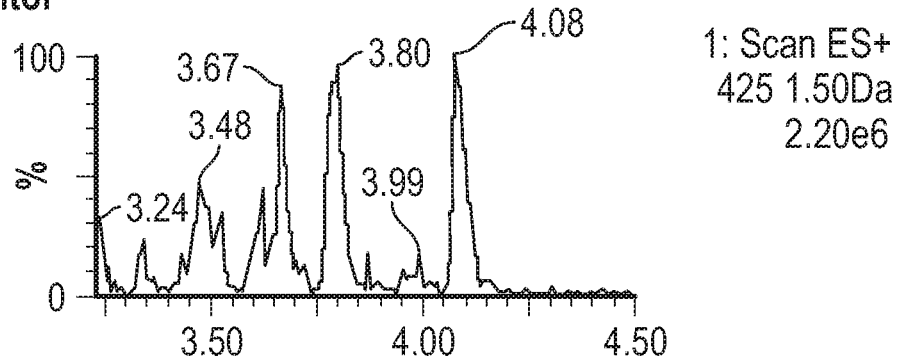
Figure 26:
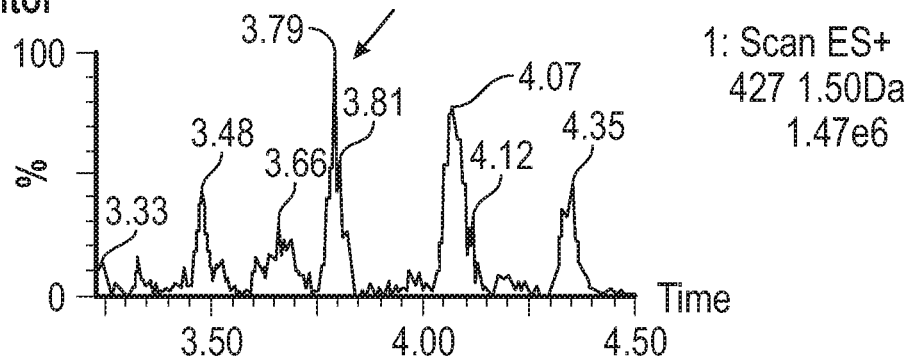

Possible dihydroxycucurbitadienol product is shown in FIG. 26.

EPH protein sequence and a DNA encoding EPH protein (codon optimized *S. cerevisiae*) is provided in SEQ ID NO: 428 and 429, respectively.

Example 58: Production of Mogrol from Cucurbitadienol Synthase, Epoxide Hydrolase, Cytochrome P450 and Cytochrome P450 Reductase Four enzymes, including Cucurbitadienol synthase, epoxide hydrolase, cytochrome P450, and cytochrome P450 reductase are co-expressed in *S. cerevisiae*. For the growth conditions SgCbQ, EPH, CYP87D18 and AtCPR (cytochrome P450 reductase from *A. thaliana*) are co-expressed in the presence of lanosterol synthase inhibitor. Production of mogrol by *S. cerevisiae* is expected. The protein sequence and DNA sequence encoding SgCbQ, EPH, CYP87D18 and AtCPR (cytochrome P450 reductase from *A. thaliana*) are: CYP87D18 (protein) (SEQ ID NO: 430), and CYP87D18 (DNA) (SEQ ID NO: 431); and AtCPR (protein) (SEQ ID NO: 432), and AtCPR (DNA) (SEQ ID NO: 433).

Example 59: Compound 1 is Tolerant to Microbial Hydrolysis

Yeast strains *Saccharomyces cerevisiae*, *Yarrowia lipolytica* and *Candida bombicola*, were incubated in YPD supplemented with 1 mg/ml Mogroside V or Compound 1. After 3 days, supernatants were analyzed by HPLC.

Figure 27A:
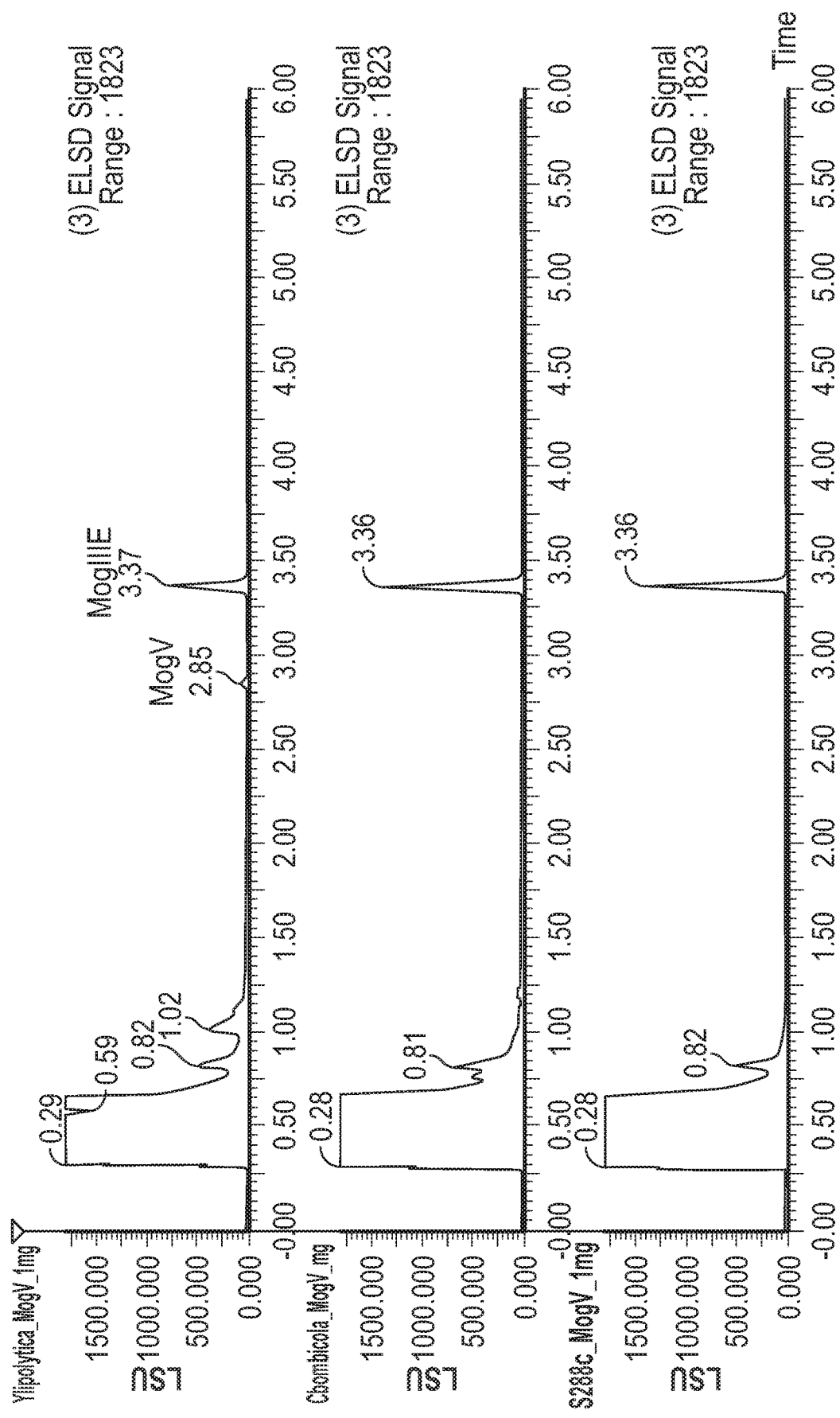
FIGS. 27A-B show tolerance of Compound 1 to hydrolysis by microbial enzymes
Figure 27B:
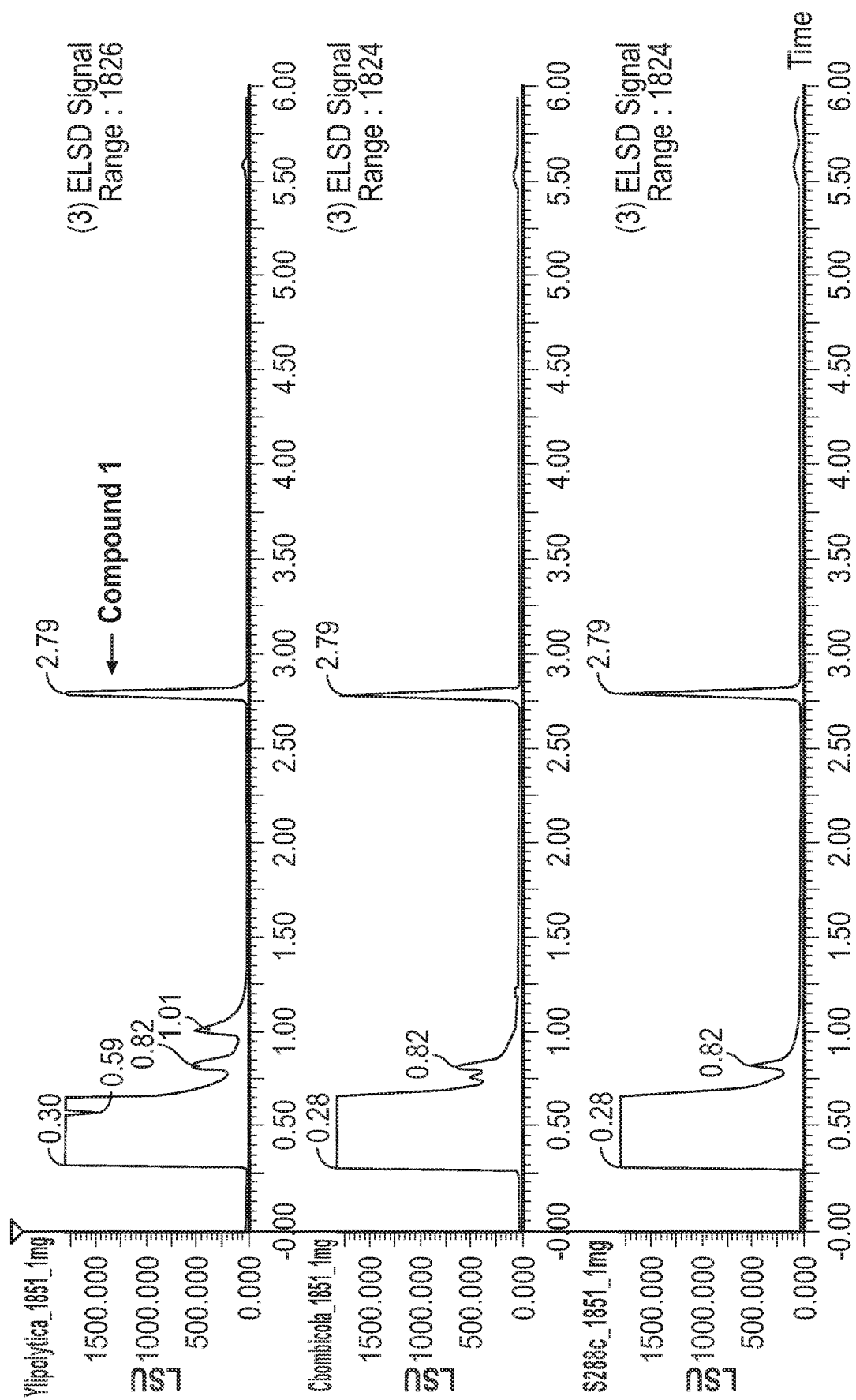

As shown in the HPLC data, the strains hydrolyzed Mogroside V to Mogroside IIIE. There was no hydrolysis products observed with Compound 1 (FIGS. 27A and 27B).

Example 60: *Streptococcus mutans* Clarke ATCC 25175 Dextransucrase

*Streptococcus mutans* Clarke can be grown anaerobically with glucose supplementation. An example of growth conditions can be found in Wenham, Henessey and Cole (1979), in which the method is used to stimulate dextransucrase production, for example. 5 mg/ml Mogroside IIIE was added to the growth media. Time point samples to monitor production can be taken for HPLC, for example. Sequences for various dextransucrase include protein sequences for dextransucrases and nucleic acid sequences that encode dextransucrases (for example, SEQ ID NOs: 157-162). In some embodiments, the dextransucrase comprises, or consists of, an amino acid sequence of any one of SEQ ID NOs: 2, 103, 106-110, 156, and 896. In some embodiments, the DexT can comprise an amino acid sequence set forth in SEQ ID NO: 103. In some embodiments, the DexT comprises a nucleic acid sequence set forth in SEQ ID NO: 104 or 105. In some embodiments, herein the recombinant cell encodes a protein comprising the sequence set forth in any one of SEQ ID NO: 156-162 and/or comprises a nucleic acid encoding dextransucrase comprising a nucleic acid sequence set forth in any one of SEQ ID NOs: 157-162. This example is used to produce Compound 1.

Example 61: 90% Pure Compound 1 Production Procedure and Sensory Evaluation

A fraction containing the mixture of 3 α-mogroside isomers is obtained by treating mogroside III$_E$ (MIII$_E$) with Dextransucrase/dextranase enzymes reaction followed by SPE fractionation. Based on UPLC analysis this mixture has 3 isomers, 11-oxo-Compound 1, Compound 1 and mogroside V isomer in 5:90:5% ratios respectively. These 3 isomers are characterized from the purification of a different fraction/source by LC-MS, 1D and 2D NMR spectra and by the comparison of closely related isomers in mogrosides series reported in the literature. This sample is further evaluated in sensory by comparing with pure Compound 1 sample using a triangle test.

Enzyme Reaction and Purification Procedure 100 mL of pH 5.5 1M sodium acetate buffer, 200 g sucrose, 100 mL dextransucrase DexT (1 mg/ml crude extract, pET23a, BL21-Codon Plus-RIL, grown in 2×YT), 12.5 g of Mogroside III$_E$ and 600 mL water were added to a 2.8 L shake flask, and the flask was shaken at 30° C. 200 rpm. The progress of the reaction was monitored periodically by LC-MS. After 72 hours, the reaction was treated with 2.5 mL of dextranase (Amano) and continued shaking the flask at 30° C. After 24 hours the reaction mixture was quenched by heating at 80° C. and centrifuged at 5000 rpm for 5 minutes and the supernatant was filtered and loaded directly onto a 400 g C18 SPE column and fractionated using MeOH:H$_2$O 5/25/50/75/100 step-gradient. Each step in the gradient was collected in 6 jars, with 225 mL in each jar. The desired products were eluted in the second jar of the 75% MeOH fraction (SPE 75_2) and dried under reduced pressure. It was further re-suspended/dissolved in 7 mL of H$_2$O, freezed and lyophilized the vial for 3 days to get 1.45 g of white solid.

Figure 28:
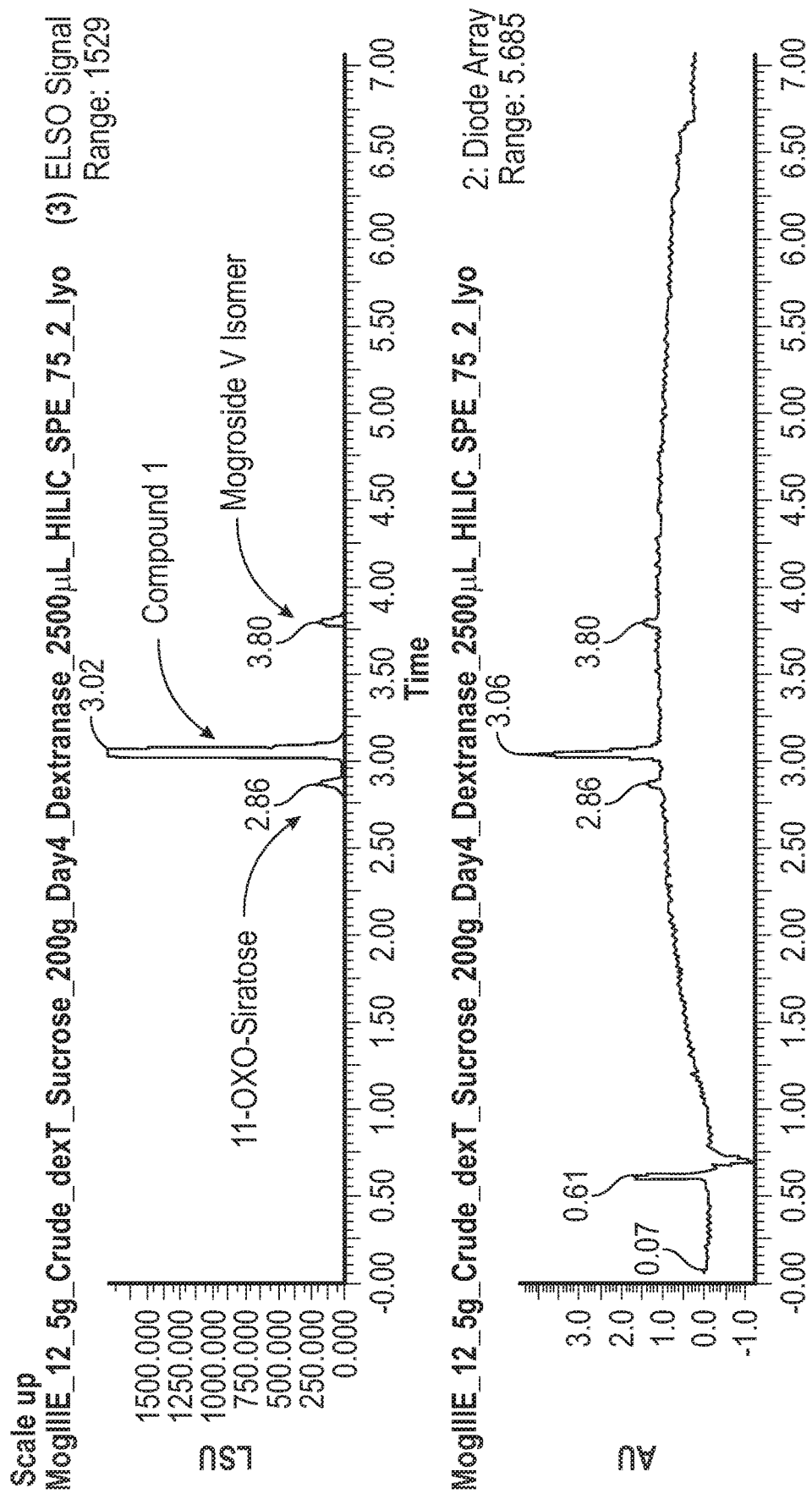
FIG. 28 shows UPLC chromatogram of α-mogroside isomers mixture from Hilic_80_20_method.
Figure 28:
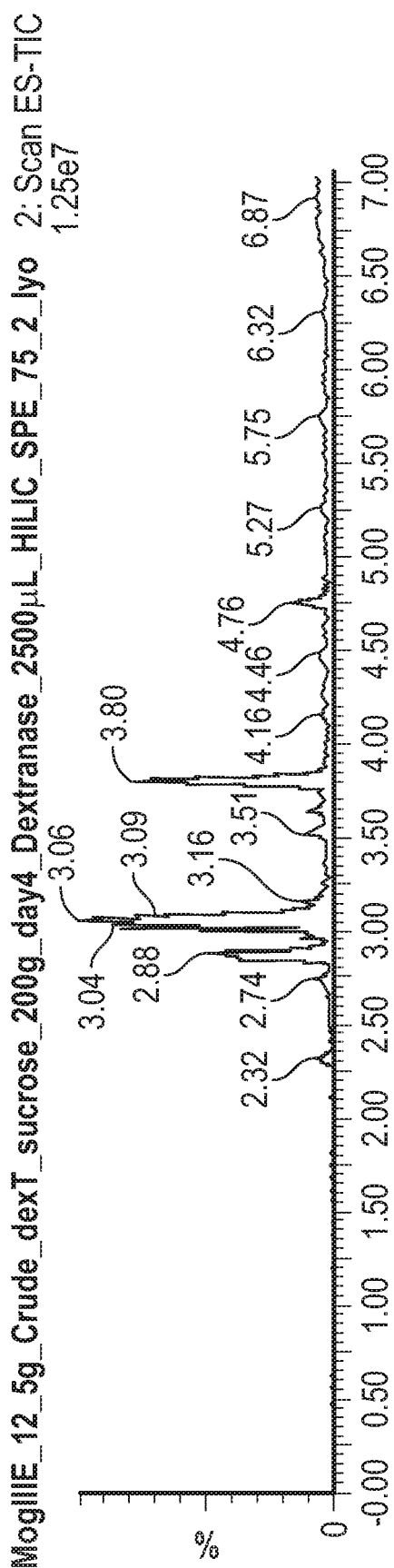
Figure 28:
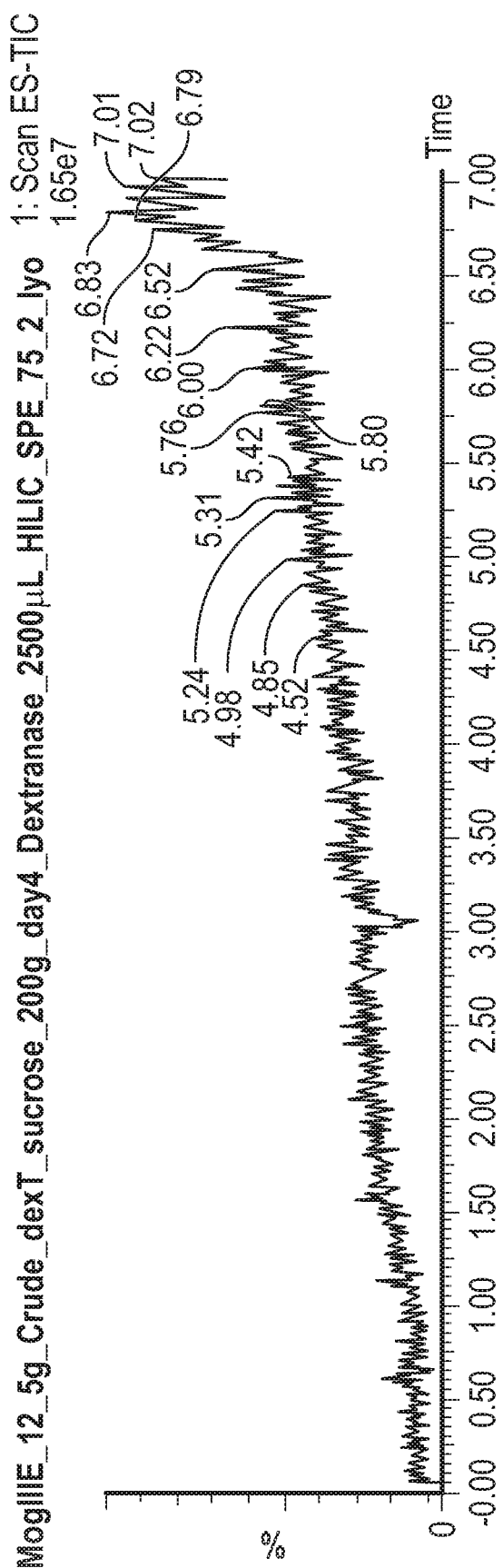
Figure 29:
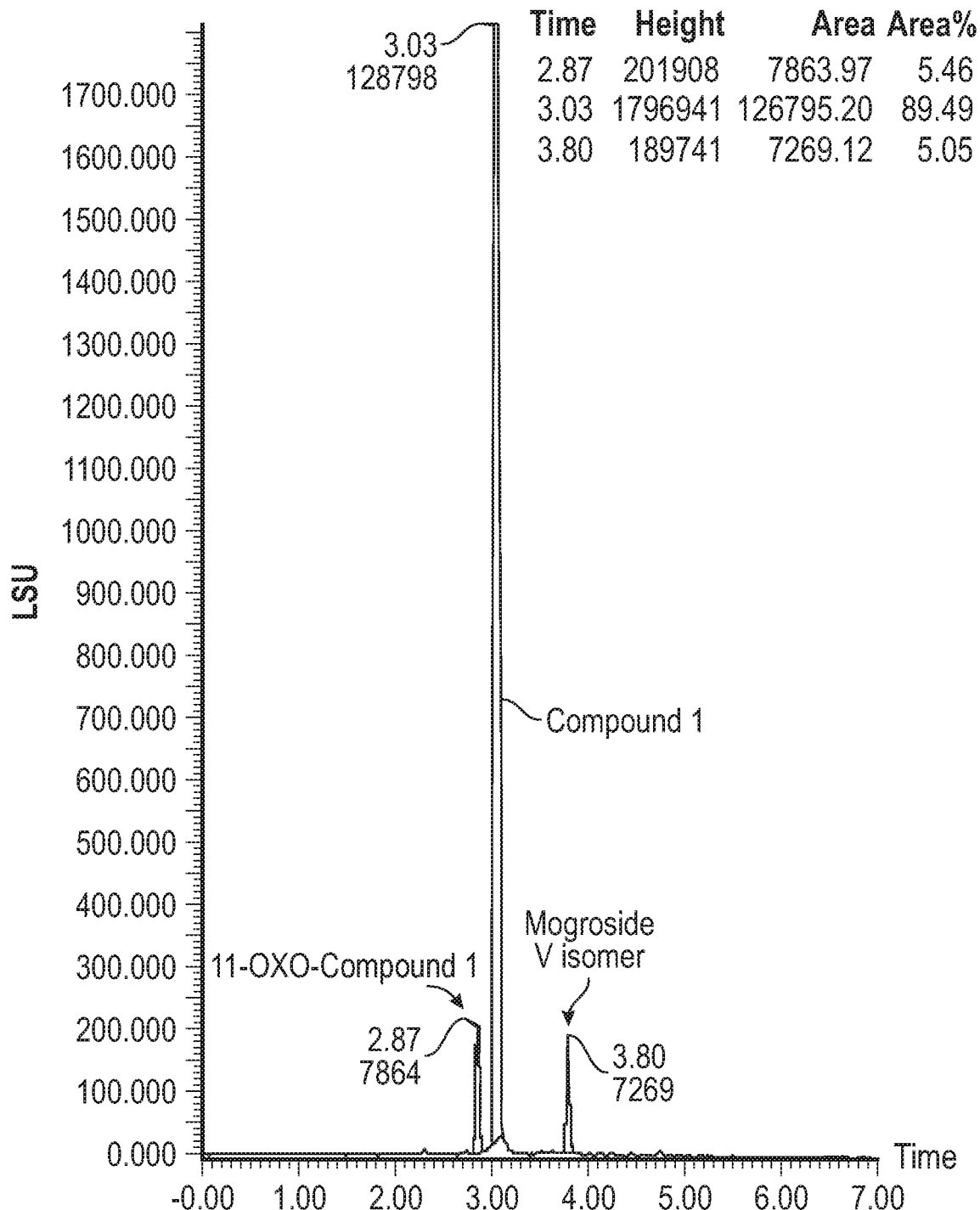
FIG. 29 shows purity of the sample from UPLC analysis on Hilic_80_20_method.
Figure 30:
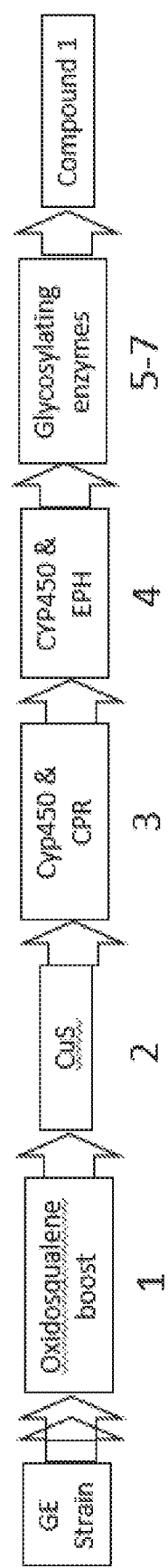
FIG. 30 shows a flow chart showing a non-limiting exemplary pathway for producing Compound 1.

As per the UPLC analysis (FIGS. 28 and 29), the mixture has 3 characterized α-mogroside isomers; 11-oxo-Compound 1, Compound 1 and mogroside V isomer in 5:90:5% ratios, respectively. No residual solvent and/or structurally unrelated impurities were observed based on $^1$H and $^{13}$C-NMR (Pyridine-d$_5$+D$_2$O) analysis.

Sensory Evaluation

Triangle testing for pure Compound 1 vs. 90% pure Compound 1 was performed on Nov. 10, 2016. Two different compositions: (1) LSB+175 ppm pure Compound 1 (standard) and (2) LSB+175 ppm 90% pure Compound 1 were tested. All samples of compositions were made with Low Sodium Buffer (LSB) pH ~7.1 and contain 0% ethanol.

Conclusions: Panelists found that composition (1) LSB+175 ppm pure_Compound 1 (standard) was not significantly different than composition (2) LSB+175 ppm 90% pure Compound 1 (test) (p>0.05). Some of the testing analytical results are shown in Tables 2-4.

TABLE 2

Frequency of panelists that correctly selected the different sample. n = 38 (19 panelists × 2 reps).

| Samples | Total |
| --- | --- |
| Incorrect | 24 |
| Correct | 14 |
| Total | 38 |
| Correct Sample Selected (p-value) | 0.381 |

TABLE 3

Analytical Results: Test Day

| Theoretical # (μM) | Observed (μM) |
| --- | --- |
| 175 ppm (155.51 uM) pure_compound 1 (standard) | 132.20 ± 1.54 (n = 2) |
| 175 ppm (155.56 uM) 90%_pure_compound 1 (test) | 157.62 ± 0.63 (n = 2) |

TABLE 4

Analytical results: the day before the testing day

| Theoretical # (µM) | Observed (µM) |
|---|---|
| 175 ppm (155.51 uM) pure_compound 1 (standard) | 134.48 ± 7.31 (n = 2) |
| 175 ppm (155.56 uM) 90%_pure_compound 1 (test) | 140.69 ± 4.34 (n = 2) |

Example 62: Gene Expression in Recombinant Yeast Cells, Sample Processing and Detection of Metabolites DNA was obtained through gene synthesis either through Genescript, IDT, or Genewiz. For some of the cucurbitadienol synthases, cDNA or genomic DNA was obtained through 10-60 day old seedlings followed by PCR amplification using specific and degenerate primers. DNA was cloned through standard molecular biology techniques or through yeast gap repair cloning (Joska et al., 2014) into one of the following overexpression vectors: pESC-Ura, pESC-His, or pESC-LEU. Gene expression was regulated by one of the following promoters; Gal1, Gal10, Tef1, or GDS. Yeast transformation was performed using Zymo Yeast Transformation Kit II. Yeast strains were grown in standard media (YPD or SC) containing the appropriate selection with 2% glucose or 2% galactose for induction of heterologous genes. Yeast strains were grown in shake flask or 96 well plates at 30° ° C., 140-250 rpm. When indicated, lanosterol synthase inhibitor, Ro 48-8071 (Cayman Chemicals) was added (50 ug/ml). Yeast samples producing mogrol precursors, mogrol and mogrosides were processed through one of the following:

- Cucurbitadienol and 11-OH Cucurbitadienol: Samples cell pellets were lysed (Yeast Buster) followed by ethyl acetate extraction, drying, and resuspension in methanol.
- Mogrol and Mogrosides: Samples cell pellets were lysed in 50% ETOH, incubated at 80° C. for 30 min, filtered, dried and resuspended in MeOH for LCMS screening.

Samples were analyzed through LCMS methods described below using A/B gradient (A=$H_2O$, B=acetonitrile):

For analyzing diepoxysqualene, the LCMS method included the use of C18 2.1×50 mm column, 5% B for 1.5 min, gradient 5% to 95% B or 5.5 min, 95% B for 6 min, 100% B for 3 min, 5% B for 1.5, and all at flow rate of 0.3 ml/min.

For analyzing cucurbitadienol, the first LCMS method included the use of C4 2.1×100 mm column, gradient 1 to 95% B for 6 minutes, and at flow rate of 0.55 ml/min; and the second LCMS method included the use of Waters Acquity UPLC Protein BEH C4 2.1×100 mM, 1.7 µm, with guard, 62 to 67% B for 2 min, 100% B for 1 min, and at flow rate of 0.9 ml/min and ESI source positive single ion monitoring of 427 and 409. Enzyme activities are displayed as LCMS peak area of product vs. peak area of internal reference.

For analyzing 11-OH cucurbitadienol, the LCMS method included the use of C8 2.1×100 mm column, gradient 60 to 90% B for 6 minutes at flow rate of 0.55 ml/min. For the enzyme screening, the LCMS method used was a Waters Acquity UPLC Protein BEH C4, 2.1×100 mm, 1.7 µm column and a gradient of 40% to 80% over 5 minutes, 95% B from 5.1 to 5.6 minutes with a flow rate of 0.55 ml/min, and ESI source positive mode single ion monitoring of 425.4. Enzyme activities are displayed as LCMS peak area of product vs. peak area of internal reference.

For analyzing Mogrol, the LCMS method included the use of C8 2.1×100 mm column, gradient 50 to 90% B for 6 minutes at flow rate of 0.55 ml/min. The other method used a Water Acquity HSS T3 C18 2.1×30 mm, 1.8 µm column, 45% B isocratic for 1 minute, 100% B at 1.3 minutes, with a flow rate of 1.3 ml/min, and an APCI source with positive mode single ion monitoring of 423.4.

For analyzing Mogroside IIIE & Compound 1, the LCMS method included the use of Fluoro-phenyl 2.1×100 mm column, gradient 15 to 30% B for 6 minutes, at flow rate of 0.55 ml/min. For analyzing yeast production of mogroside I during enzyme screening, the LCMS method used a Phenomenex Kinetex Polar C18, 4.6×100 mm, 2.6 µm column, and a gradient of 25% to 55% B over 3 minutes, and 100% B at 3.5 minutes with a flow rate of 1.5 ml/min. Detection by ESI source negative mode single ion monitoring of 683.4 for mogroside I and 799.4 for mogroside II.

Example 63

Step 1. Boosting Oxidosqualene Availability

Figure 31:
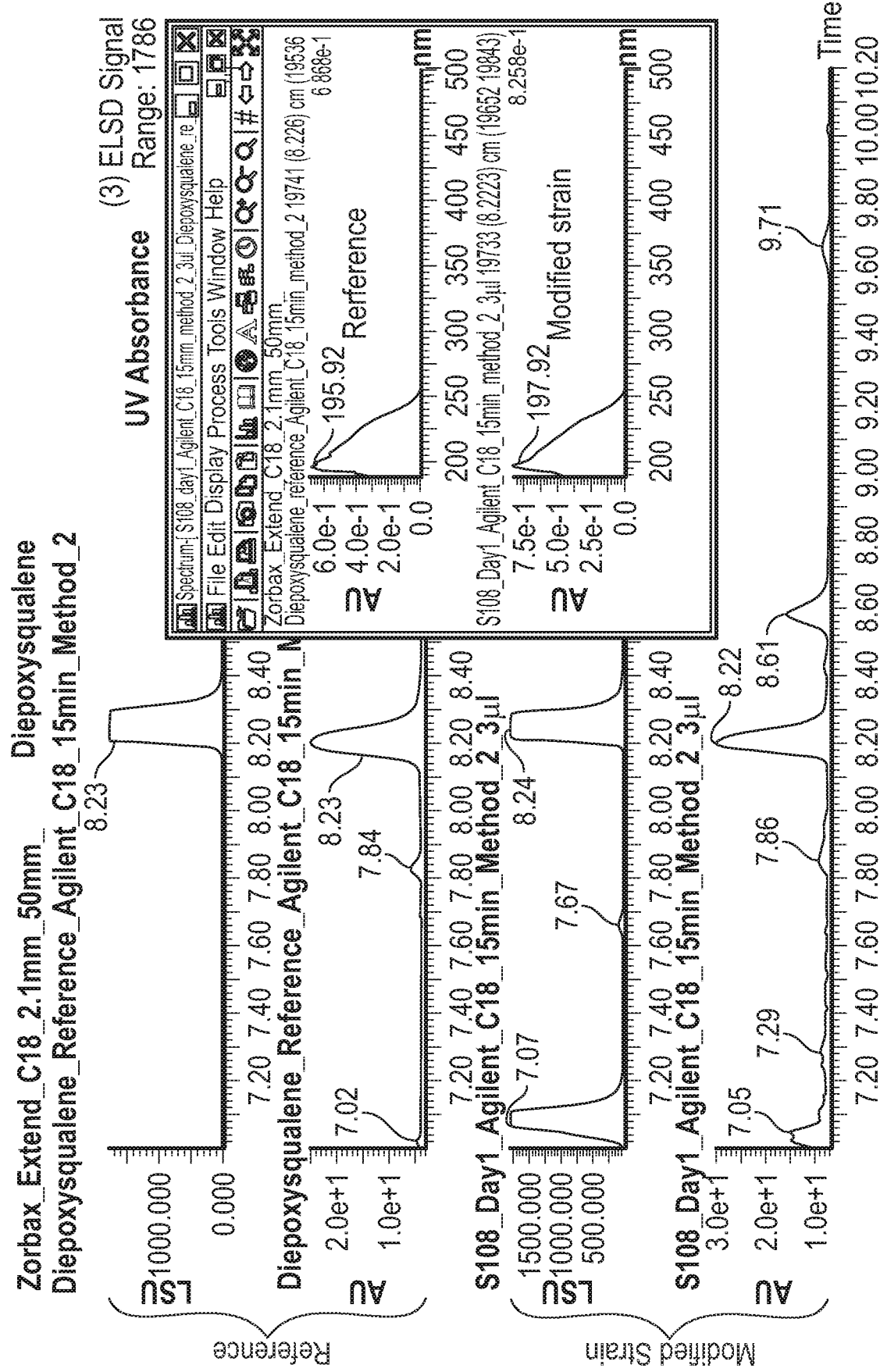
FIG. 31 shows the UV absorbance of the diepoxysqulene of Step 1 shown in FIG. 30 for boosting oxidosqualene.

*Saccharomyces cerevisiae* strain YHR072 (heterozygous for lanosterol synthase erg7) was purchased from GE Dharmacon. Expression of active erg7 gene was reduced by replacing the promoter with that of cup1 (Peng et al., 2015). A truncated yeast HMG-COA reductase (tHMG-COA) under control of GDS promoter and yeast squalene epoxidase (erg1) under the control of Tef1 promoter was integrated into the genome. Oxidosqualene boost was monitored by the production of diepoxysqualene as shown in the HPLC and UV absorbance (FIG. 31).

tHMG-COA (protein) SEQ ID NO:898 (pathway 1)
tHMG-COA (DNA) SEQ ID NO:897 (pathway 1)
Erg1 (protein) SEQ ID NO: 900; Erg1 (DNA) SEQ ID NO: 899

In some embodiments, tHMG-COA enzyme is used for the production of diepoxysqualene.

Genes encoding for putative squalene epoxidases in *S. grosvenorii* (Itkins et al., 2016) were selected to test for boosting oxidosqualene/diepoxysqualene production. The amino acid and coding sequences of three squalene epoxidases are shown in SEQ ID NO: 50-56, 60, 61, 334, and 335. Additional sequences for squalene epoxidases suitable to use in the methods, systems and compositions disclosed herein for producing oxidosqualene and/or diepoxysqualene, and for boosting the production of oxidosqualene and/or diepoxysqualene include: SQE1 (protein) SEQ ID NO: 908, SQE1 (DNA) SEQ ID NO: 909; SQE2 (protein) SEQ ID NO: 910, SQE2 (DNA) SEQ ID NO: 911; SQE3 (protein) SEQ ID NO: 912, and SQE3 (DNA) SEQ ID NO: 913.

Step 2. Cucurbitadienol Production
Cucurbitadienol Synthase Enzymes

Figure 32:
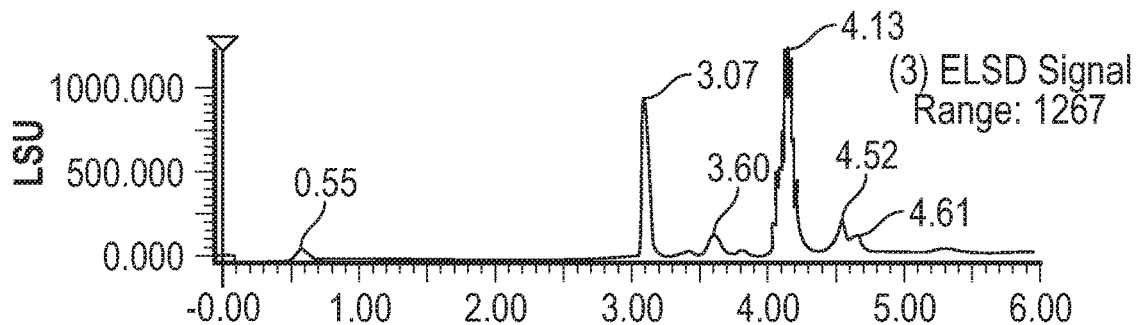
FIG. 32 shows production of cucurbitadienol in step 2 using enzymes from Cucumis melo and Cucurbita maxima
Figure 32:
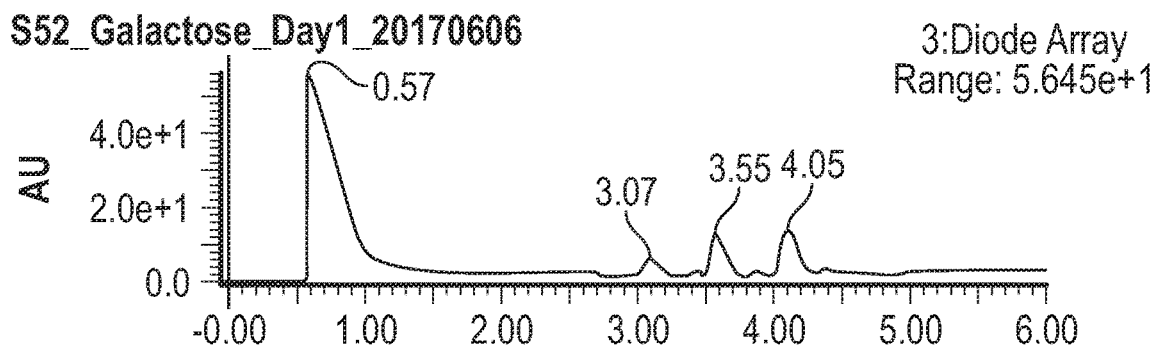
Figure 32:
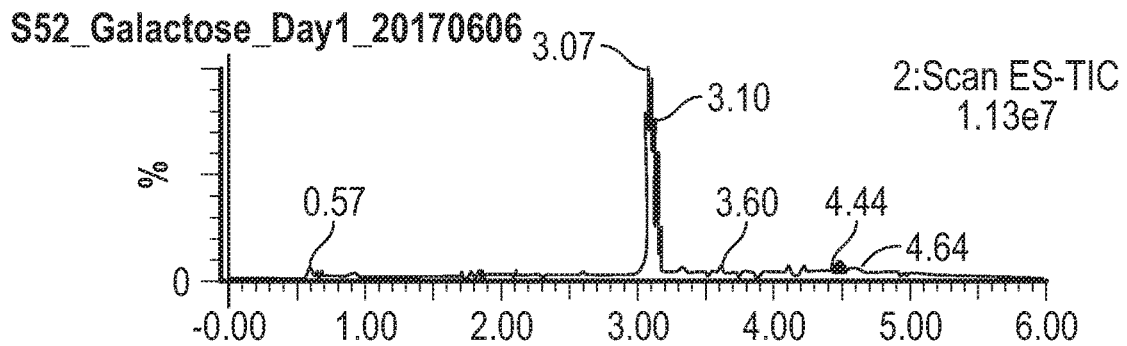
Figure 32:
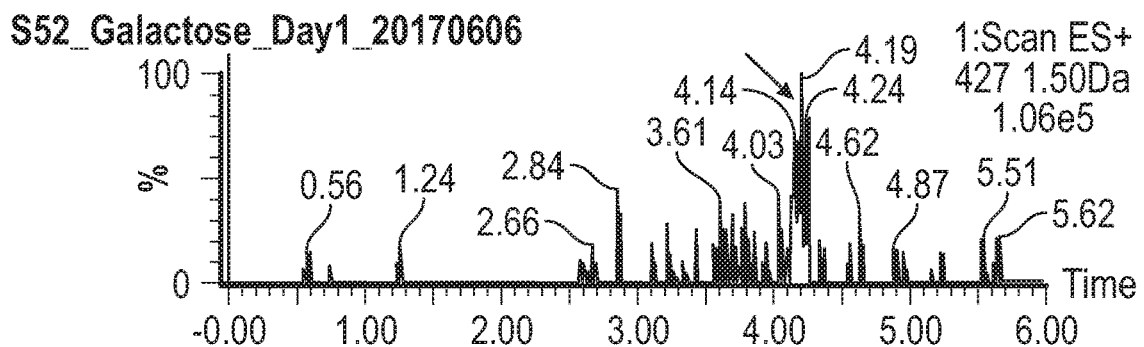
Figure 32:
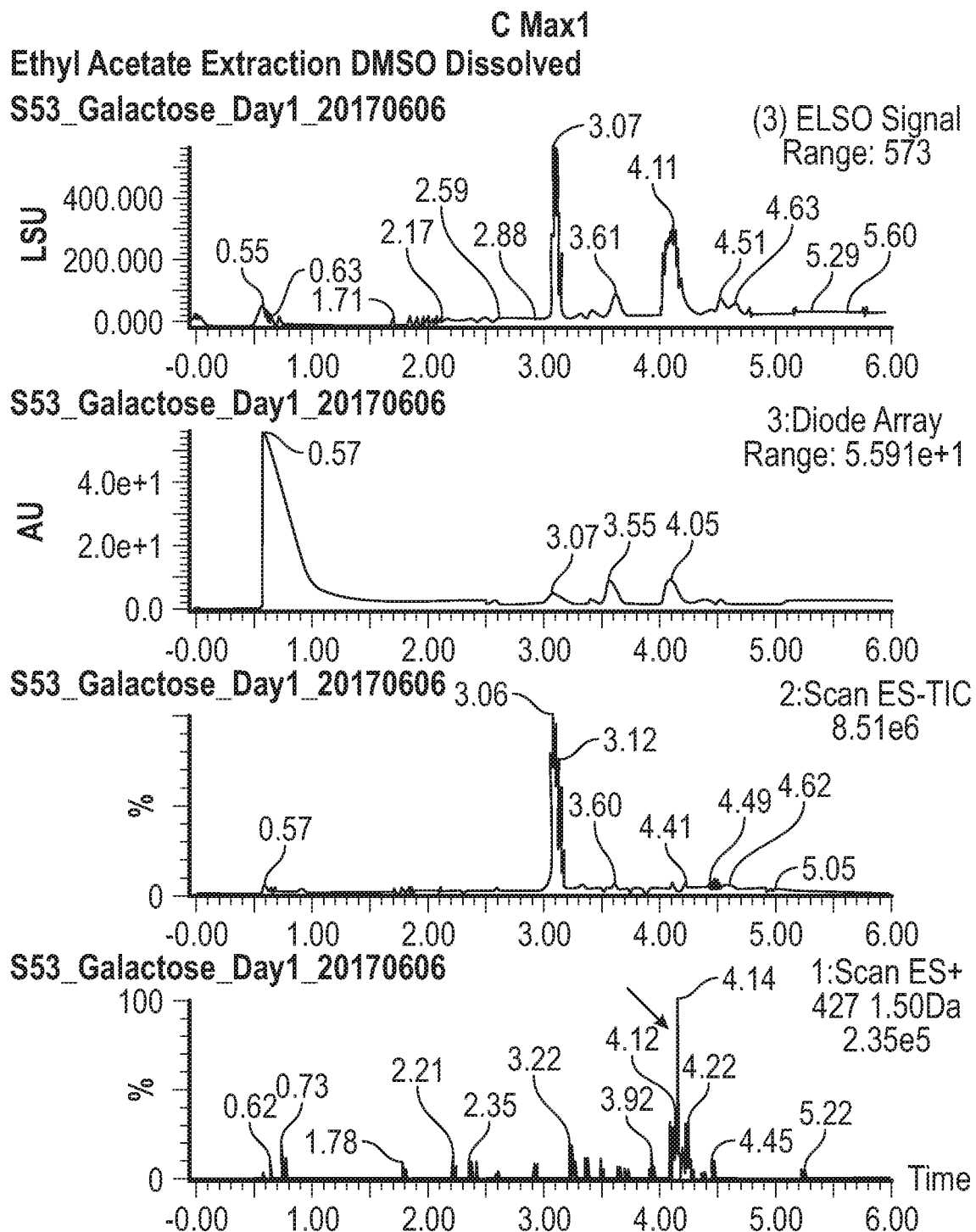

Plasmids containing *S. grosvernorii* cucurbitadienol synthase gene (SgCbQ) were transformed into yeast strain with oxidosqualene boost. Strains were grown 1-3 days at 30 C, 150-250 rpm. Production of cucurbitadienol is shown in the HPLC and mass spectroscopy data which show mass peaks for the indicated product (FIG. 23). The SgCbQ protein and gDNA encoding SgCbQ is provided in SEQ ID NO: 446 and SEQ ID NO: 418, respectively. *Cucurbita pepo* (Jack O'Lantern) protein Cpep2 was also used for the production of cucurbitadienol in yeast. FIG. 24 shows the mass spectroscopy profile which contains peaks and characteristic fragments that correspond with cucurbitadienol. The Cpep2 protein and DNA encoding Cpep2 is provided in SEQ ID NO: 420 and SEQ ID NO: 421, respectively. *Cucurbita pepo* (Jack O'Lantern) protein Cpep4 was also used in the production of cucurbitadienol. The host cells were cultivated under the growth conditions with no inhibitor. Production of cucurbitadienol is demonstrated in the mass spectral data shown in FIG. 25. As shown, the peaks and fragments correspond to cucurbitadienol. The Cpep4 protein and DNA encoding Cpep4 is provided in SEQ ID NO: 422 and SEQ ID NO: 423, respectively. The *Cucurbita maxima* protein Cmax was also used for the production of cucurbitadienol in yeast. FIG. 32 shows the mass spectroscopy profile which contains peaks and characteristic fragments that correspond with cucurbitadienol. The Cmax1 protein sequence is provided in SEQ ID NO: 424, and the coding sequence for Cmax1 (DNA) is provided in SEQ ID NO: 425. *Cucumis melo* protein Cmelo was also used for the production of cucurbitadienol in yeast. FIG. 32 shows the mass spectroscopy profile which contains peaks and characteristic fragments that correspond with cucurbitadienol. The Cmelo protein sequence is provided in SEQ ID NO: 902, and the coding sequence for Cmelo (DNA) is provided in SEQ ID NO: 901. It is expected that *Cucurbita moschata* protein Cmos1 can also be used for the production of cucrbitodienol in recombinant host cells, for example yeast cells. Cmos1 sequences Cmos1 (protein) (SEQ ID NO: 426) and Cmos1 (DNA) (SEQ ID NO: 427) were obtained through alignment of genomic DNA PCR product sequence with known cucurbitadienol synthase sequences available through public databases (Pubmed). It is expected that Cmost 1 protein (SEQ ID NO: 426) can be used for the production of cucurbitadienol in recombinant host cells, for example yeast cells.

Converting Other Oxidosqualene Cyclases into a Cucurbitadienol Synthase

Plasmids containing modified oxidosqualene genes were transformed into yeast strain with oxidosqualene boost. Strains were grown 1-3 days at 30 C. 150-250 rpm.

Figure 33:
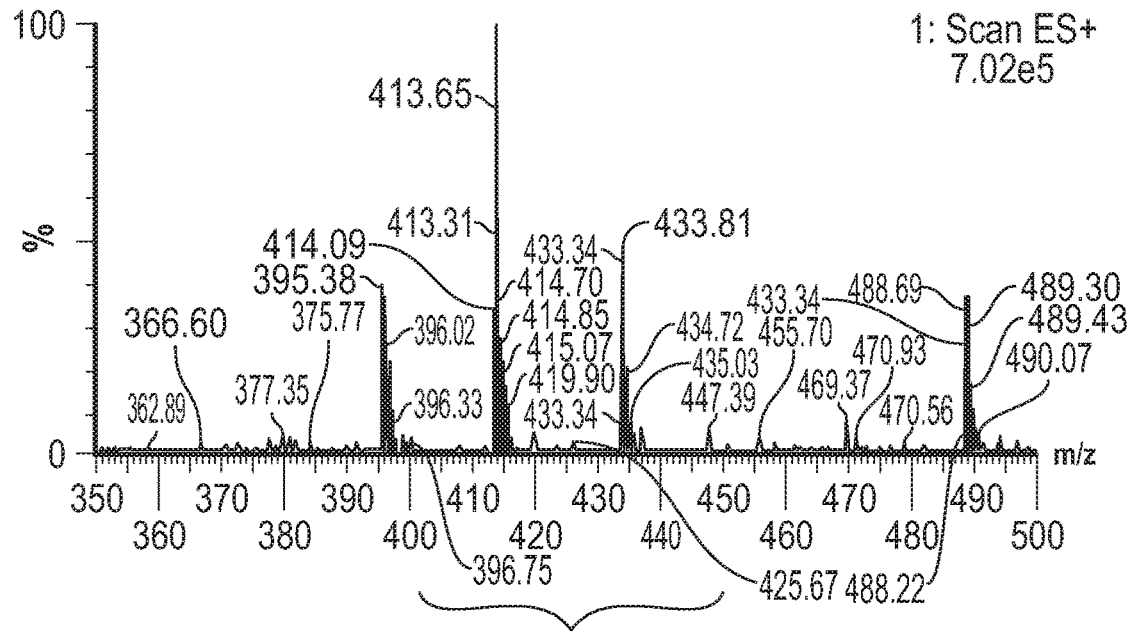
FIG. 33 shows production of cucurbitadienol in step 2 using enzyme from Pisum sativum.
Figure 33:
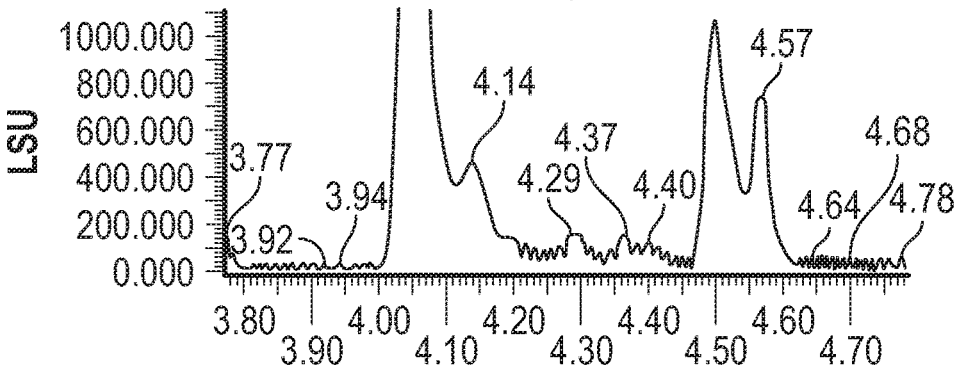
Figure 33:
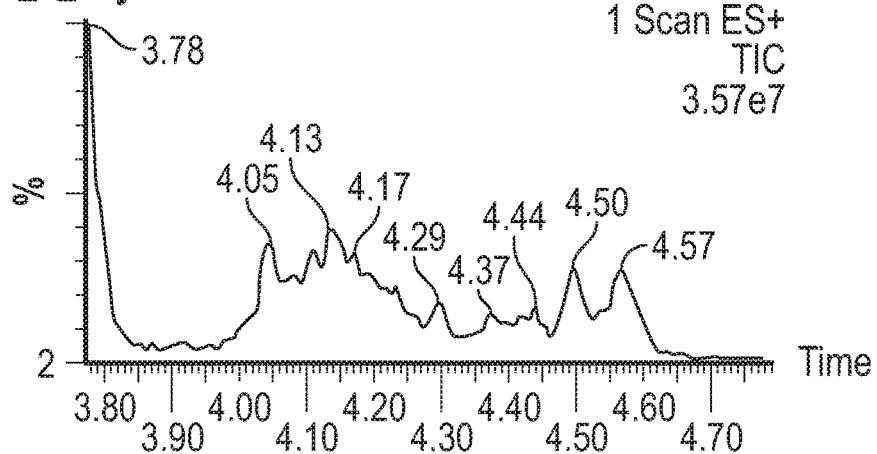
Figure 33:
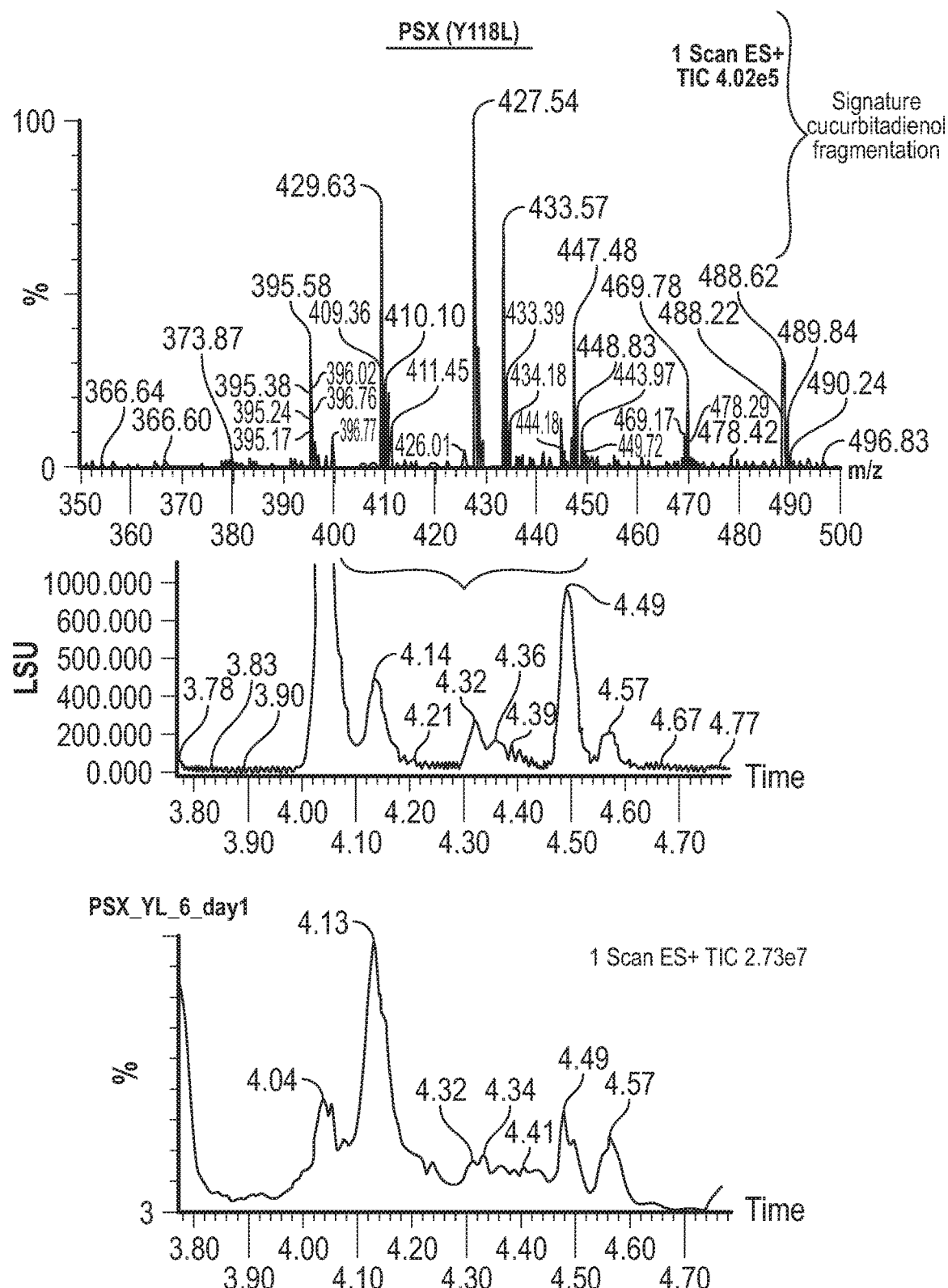

The protein PSX Y118L from the native host *Pisum sativum* was also used for the production of cucurbitadienol in yeast. FIG. 33 shows the mass spectroscopy profile which contain peaks and characteristic fragments that correspond with cucurbitadienol when the tyrosine at position 118 is converted into leucine. The sequences for the protein and DNA encoding the modified oxidosqualene cyclase are: PSXY118L (protein) (SEQ ID NO: 904) and PSXY118L (DNA, codon optimized) (SEQ ID NO: 903).

Figure 34:
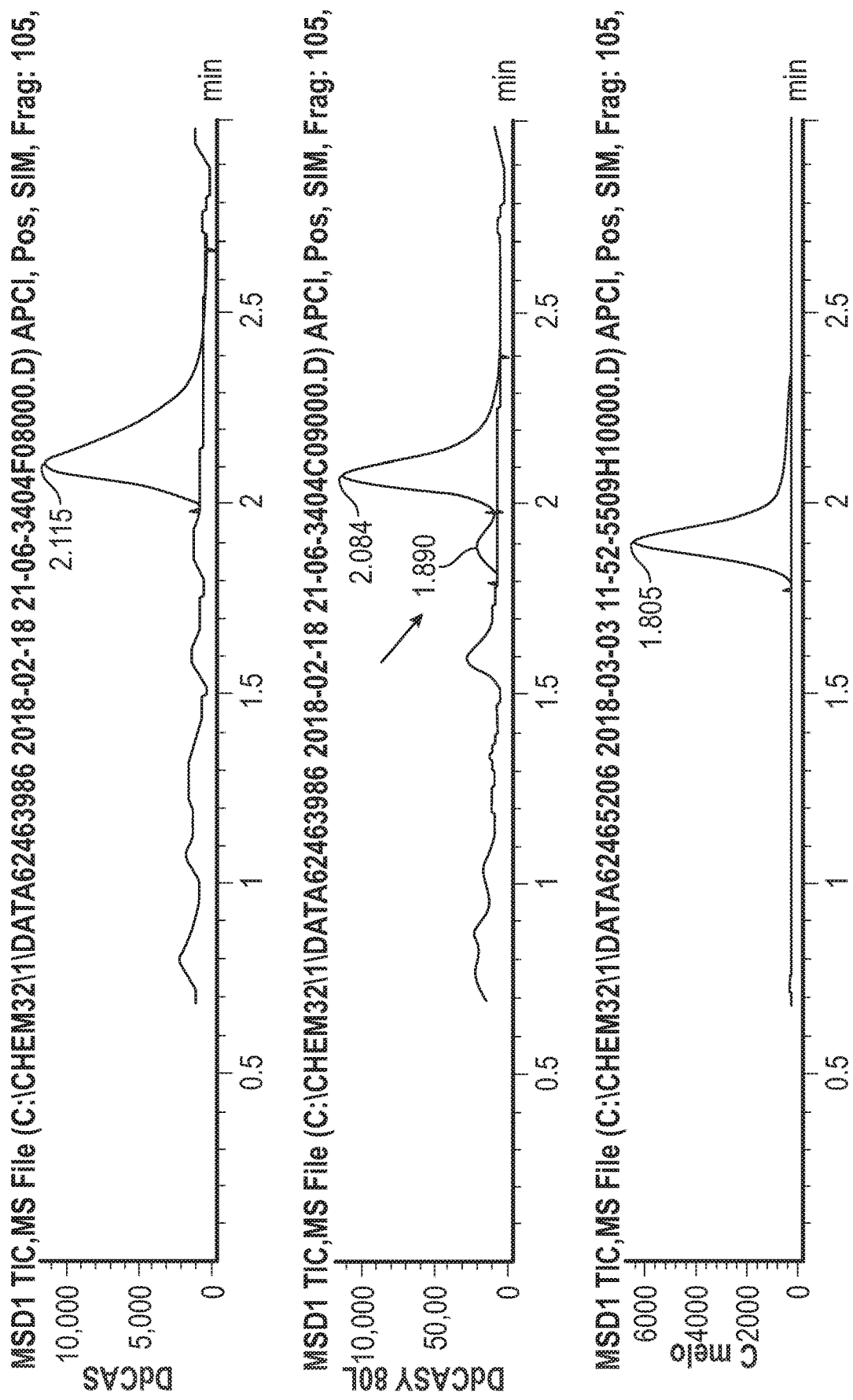
FIG. 34 shows production of cucurbitadienol in step 2 using enzyme from Dictyostelium sp.

The oxidosqualene cyclase from *Dictyostelium* sp. was also used for the production of cucurbitadienol in yeast. As shown in FIG. 34, the HPLC peak of cucurbitadienol is shown when the tyrosine at position 80 is converted into leucine. The sequences for the protein and DNA encoding the modified oxidosqualene cyclase are: DdCASY80L (protein) (SEQ ID NO: 906) and DdCASY80L (DNA) (SEQ ID NO: 905).

Improving Cucurbitadienol Synthase Activities

The gene encoding for a cucurbitadienol synthase form *Cucumis melo* was codon optimized (SEQ ID: 907) and used as a starting point for generating a library of modifications. Modifications were introduced through standard molecular biology techniques consisting of fusion peptides at the N-terminus (i.e., 5') or C-terminus (i.e., 3') end of the enzyme. Plasmids libraries of modified cucurbitadienol synthase genes were transformed into a yeast strain with oxidosqualene boost. Enzyme activities were measured by ratios of peak heights or areas of 409 and 427 positive mass fragments at the expected retention times for cucurbitadienol vs. an internal standard using LCMS method 2 described above. Enzyme performance were scored as average % activities over the average activities of the parent enzyme (n=8). Step 1 sequences of the enzymes and the sequences that encode the enzyme can be found in SEQ ID NOs: 951-1012. Step 1 sequence also include the fusions SS2c-G10, SS2e-A7b, SS2d-G11. SS2e-A7a, SS4d-G5, SS4d-C7, SS3b-D8, and SS2c-A10a are disclosed herein.

Step 3. Production of 11-OH Cucurbitadienol

Figure 35:
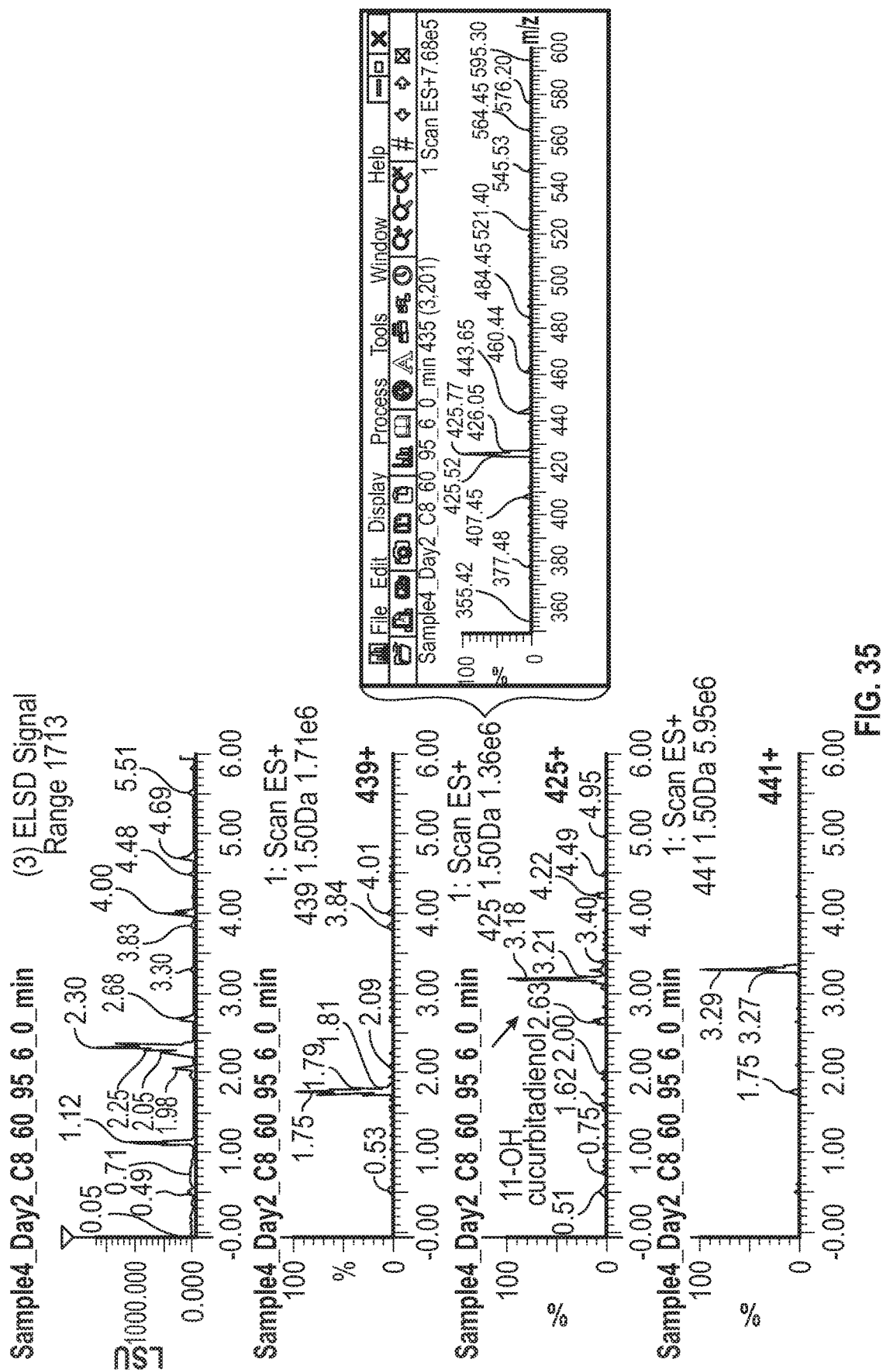
FIG. 35 shows the intermediates of Step 3 of the pathway shown in FIG. 30.

CYP87D18 (CYP450, *S. grosvenorii*) and SgCPR (CYP450 reductase, *S. grosvenorii*) were expressed in *S. cerevisiae* strain producing cucurbitadienol. 11-OH cucurbitadienol (i.e., 11-hydroxy cucurbitadienol) was observed using HPLC and mass spectroscopy data (FIG. 35). *S. grosvenorii* CYP87D18 protein sequence is shown in SEQ ID NO: 872, and CYP87D18 (codon optimized DNA) coding sequence is shown in SEQ ID NO: 871. *S. grosvenorii* SgCPR protein sequence is shown in SEQ ID NO: 874, and SgCPR1 (codon optimized DNA) coding sequence is shown in SEQ ID NO: 873.

Figure 44:
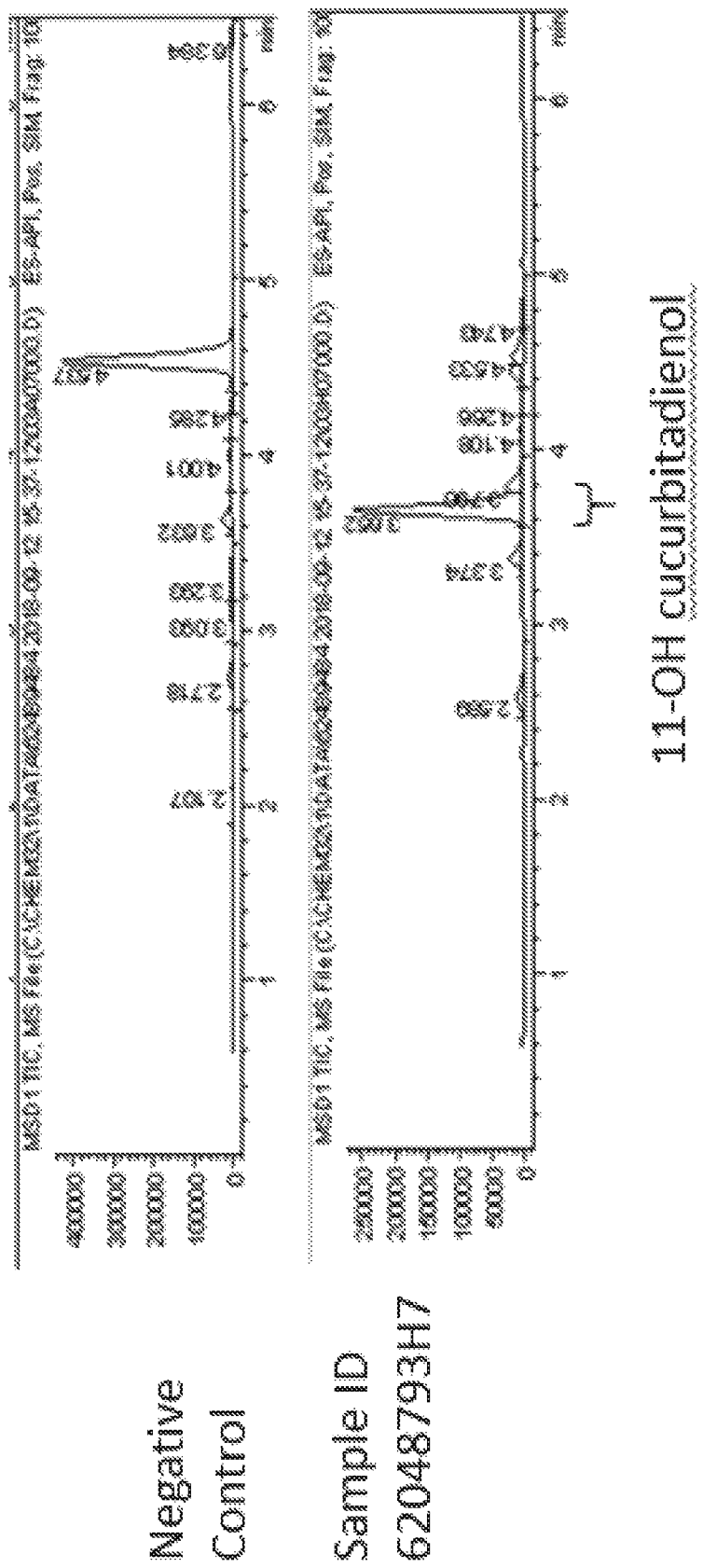
FIG. 44 shows production of 11-OH cucurbitadienol.

Additional CYP450s were expressed in *S. cerevisiae* strain producing cucurbitadienol and expressing SgCPR. CYP450s leading to production of 11-OH Cucurbitadienol are provided in Table 5. DNA and protein sequences for the CYP450 enzymes are shown in SEQ IDs 871-890 and 1024-1049 (see Table 1). Sample LCMS data is provided in FIG. 44.

TABLE 5

Enzymes displaying 11-OH cucurbitadienol production from cucurbitadienol identified by LCMS. Hits were selected from calculated peak areas corresponding to 11-OH cucurbitadienol over vector only control

| DNA/Protein SEQ ID NO. for the Enzyme | Peak Area 11-OH CCB |
| --- | --- |
| 1024/1025 | 1.231 |
| 1026/1027 | 0.9893 |
| 1028/1029 | 0.9703 |
| 1030/1031 | 0.9207 |
| 889/890 | 0.649 |
| 1032/1033 | 0.4459 |
| 62048792D6 | 0.4362 |
| 1034/1035 | 0.3854 |
| 1036/1037 | 0.3833 |
| 1038/1039 | 0.3528 |
| 1040/1041 | 0.3523 |
| 1042/1043 | 0.3326 |
| 1044/1045 | 0.2664 |
| 1046/1047 | 0.2276 |
| 1048/1049 | 0.2083 |

Step 4. Production of Mogrol

Figure 36:
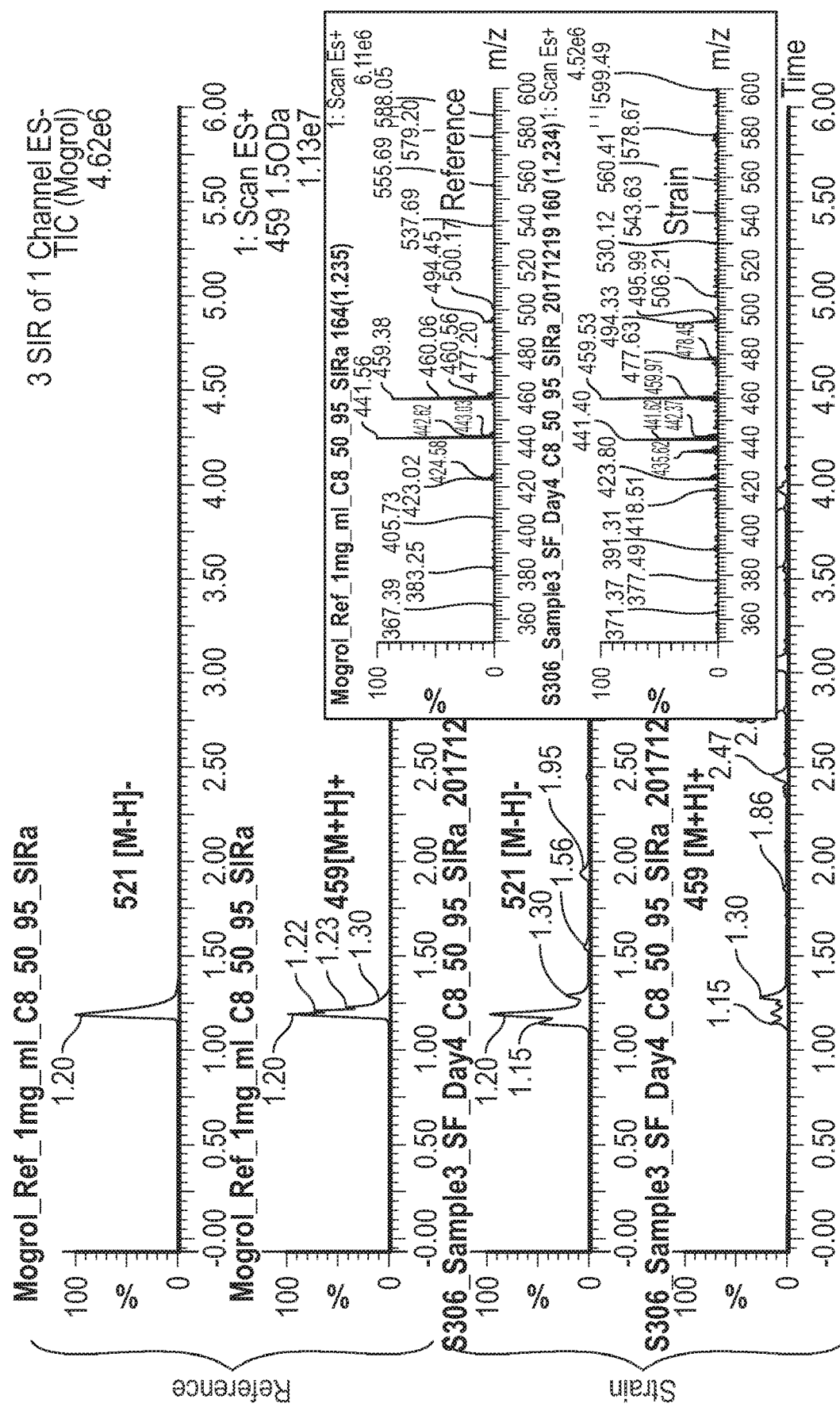
FIG. 36 shows the mass spectroscopy data of the intermediates of step 4 of the pathway shown in FIG. 30, mogrol synthesis.

CYP1798 (CYP450 enzyme, *S. grosvenorii*) and EPH2A (epoxide hydrolase, *S. grosvenorii*) were expressed in *S. cerevisiae* strain producing 11-OH cucurbitadienol. Mogrol was observed using HPLC and mass spectroscopy data (FIG. 36). For sequences, DNA coding and protein sequences for the enzymes are provided in SEQ ID NOs: 891-894.

Figure 46:
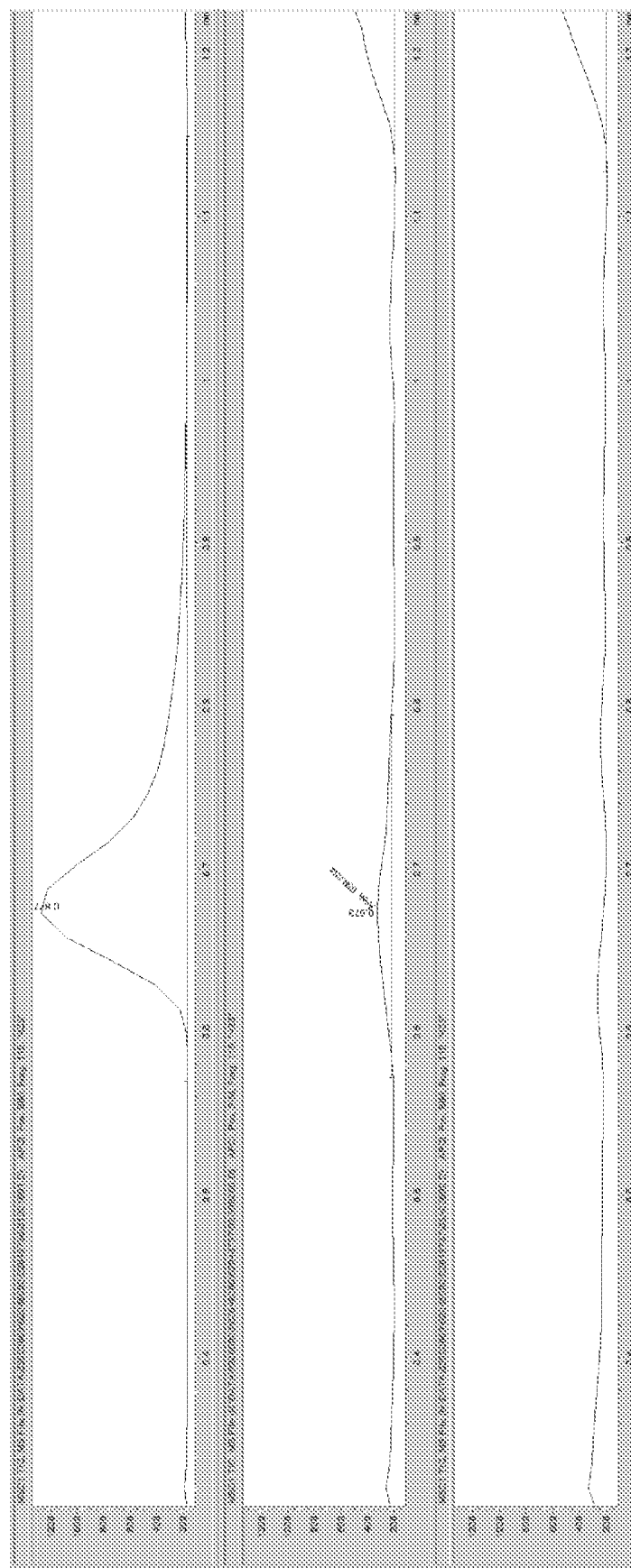
FIG. 46 shows production of mogrol.

Additional EPHs were tested in a yeast strain producing mogrol precursors. One of the EPHs (coding DNA sequence and protein sequence are shown in SEQ ID NO. 1072 and 1073, respectively) showed the ability to produce mogrol (FIG. 46).

Epoxidation of Cucurbitadienol and/or 11-OH Cucurbitadienol

Additional CYP450s and SQEs from *S. grosvenorii* and *Glycyrrhiza* (CYP88D6) were also expressed in *S. cerevi-* siae strain producing cucurbitadienol or 11-OH cucurbitadienol to test for epoxidation.

For SQEs, protein and DNA coding sequences for the enzymes are provided in SEQ ID NOs: 882-888. For CYP450s, protein and DNA coding sequences for the enzymes are provided in SEQ ID NOs: 875-890.

Step 7: Production of Compound 1 from Mogroside IIIE in *S. cerevisiae*.

Figure 37:
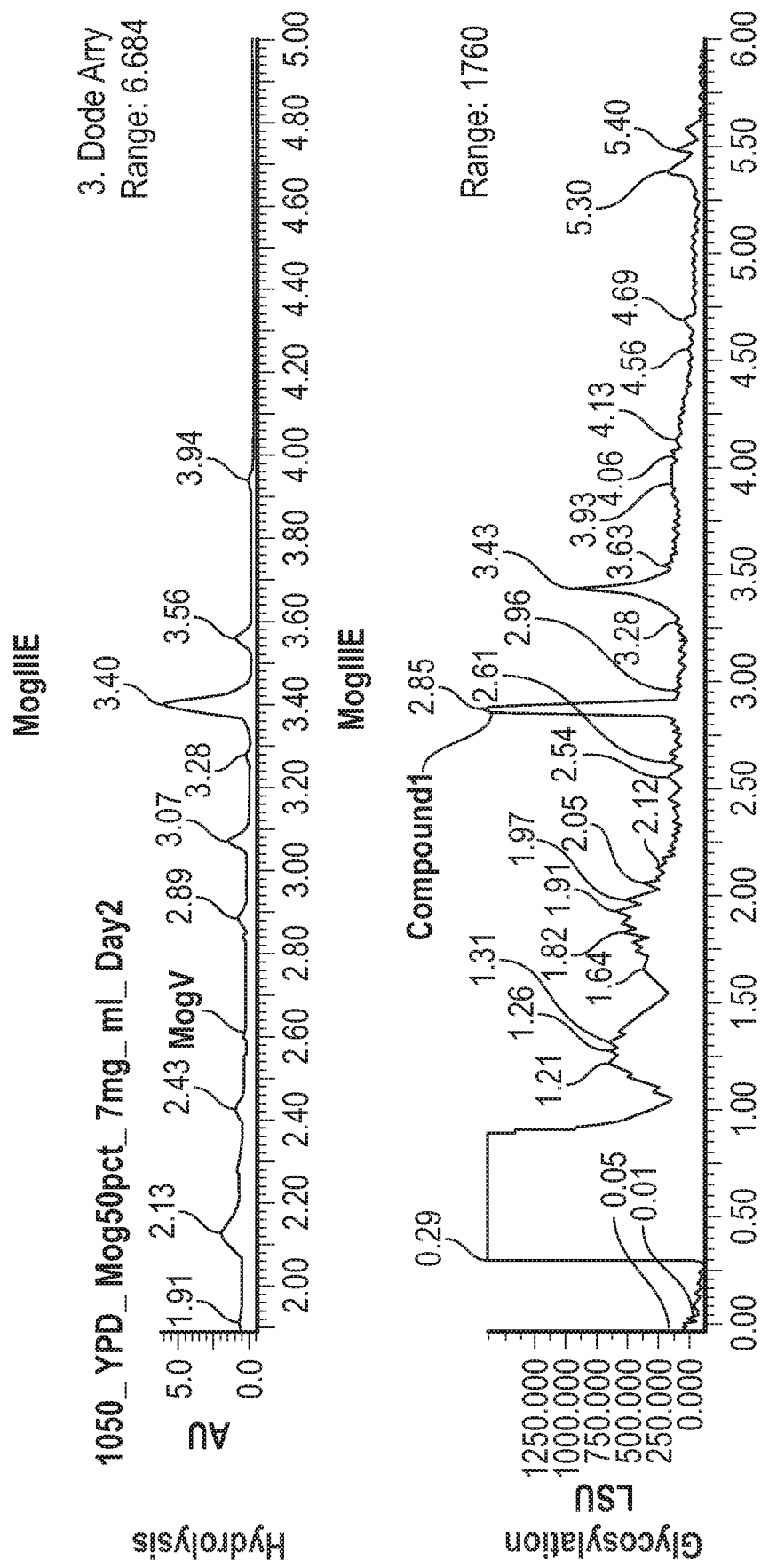
FIG. 37 shows the intermediates of step 7 of the pathway shown in FIG. 30, synthesis of Compound 1.

*S. cerevisiae* strain expressing a truncated dextransucrase (tDexT) was incubated in YPD (30 C, 250 rpm) containing 7 mg/ml Mogroside V for 1-2 day resulting in hydrolysis to Mogroside IIIE. The *S. cerevisiae* cells were harvested, lysed, and then mixed back with the YPD supernatant containing Mogroside IIIE. To initiate the dextransucrase reaction, sucrose was added to a final concentration of 200 g/L, followed by incubation at 30 C, 250 rpm for 2 days. Production of Compound 1 was observed using HPLC (FIG. 37). Protein sequence for tDexT is shown in SEQ ID NO: 896, and the DNA coding sequence for tDexT is shown in SEQ ID NO. 895.

Example 64

Figure 40A:
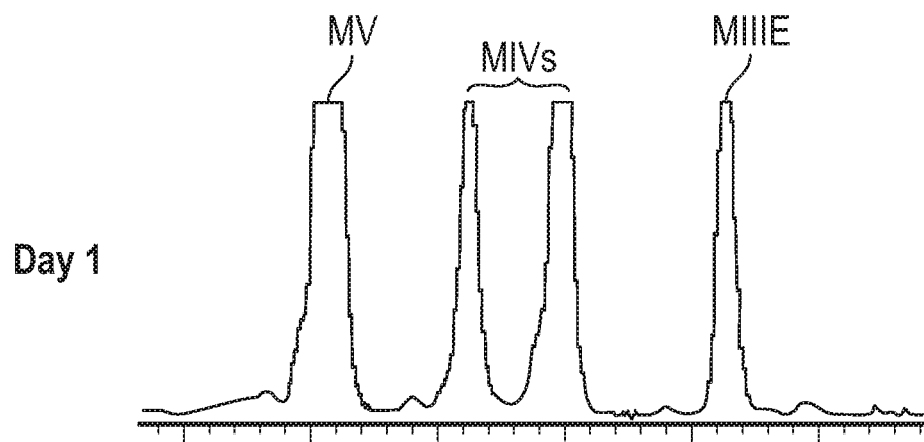
FIGS. 40A-B show that after 2 days of incubation, substantially all of the mogrosides were converted to Mogroside IIIE in S. cerevisiae or Y. lipolytica.
Figure 40A:
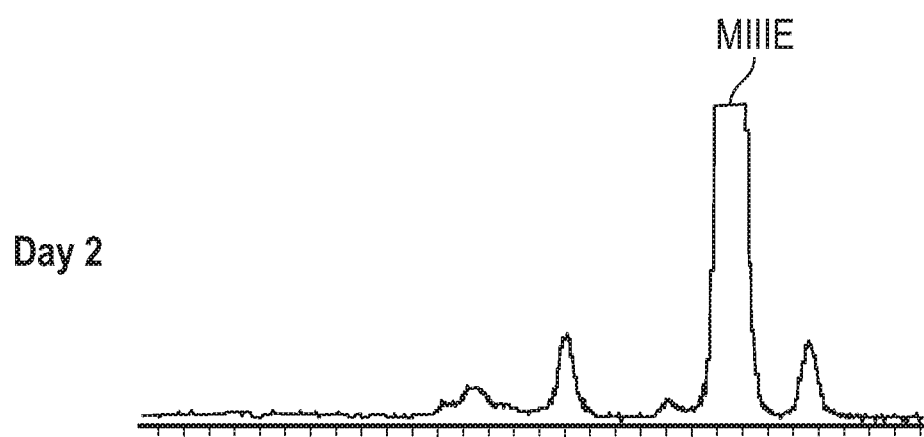

*S. cerevisiae* or *Y. lipolytica* was grown in the presence of Mogroside V to allow the hydrolytic enzymes in the yeast to generate Mogroside IIIE. After 1 or 2 days, the cells were lysed in analyzed by HPLC to determine the mogroside content. After 1 day of incubation, *S. cerevisiae* produced a mixture of Mogroside V, Mogrosides IV, and Mogroside IIIE. After 2 days of incubation, substantially all of the mogrosides were converted to Mogroside IIIE as shown in FIG. 40A.

Figure 40B:
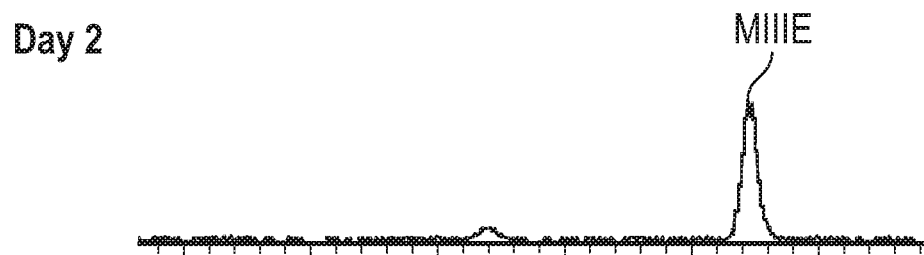

Similarly, after 2 days of incubation *Y. lipolytica* produced mostly Mogroside IIIE (shown in FIG. 40B).

Example 65

Figure 41:
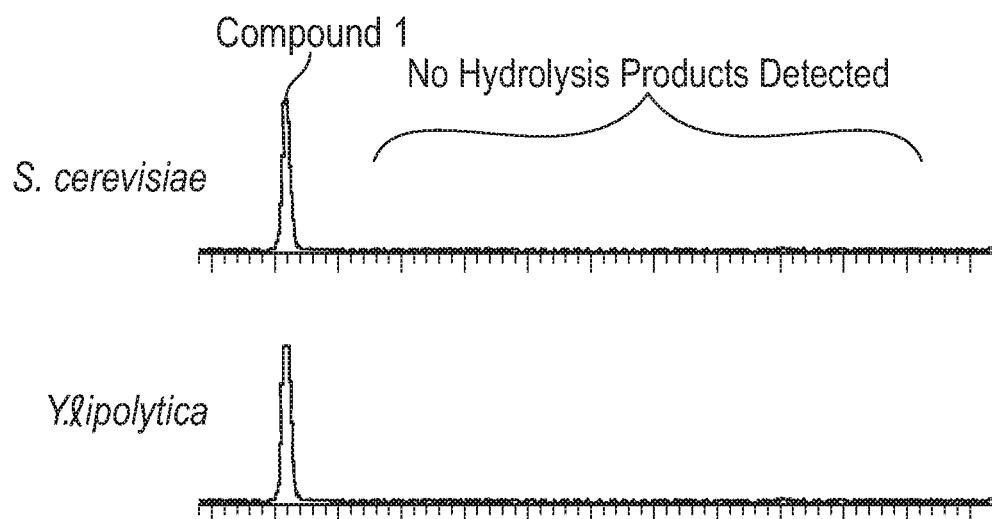
FIG. 41 shows that no hydrolysis product from Compound 1 was detected from in S. cerevisiae or Y. lipolytica.

*S. cerevisiae* or *Y. lipolytica* was grown in the presence of Compound 1. Unlike other mogrosides (see Example 64), no hydrolysis products due to hydrolysis of Compound 1 was observed as shown in FIG. 41.

Example 66

Figure 42:
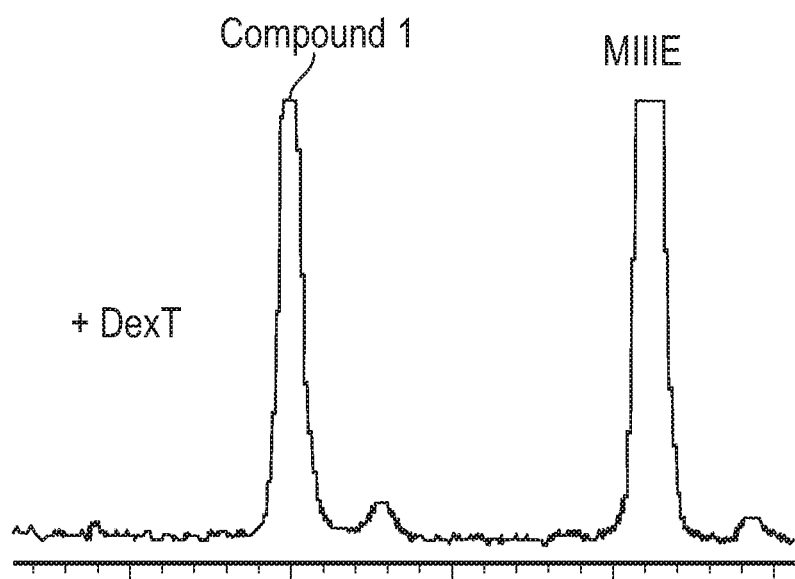
FIG. 42 shows production of Compound 1 in S. cerevisiae modified to overexpress a dextransucrase (DexT).

*S. cerevisiae* was modified to overexpress a dextransucrase (DexT). This modified strain was grown in the presence of a mogrosides mixture to allow the hydrolytic enzymes in *S. cerevisiae* to generate Mogroside IIIE. After 2 days of incubation, the cells were lysed to release the DexT enzyme and supplemented with sucrose. After 24 hours, significant amounts of Compound 1 was produced (shown in FIG. 42)

Example 67: Generation of Fusion Proteins Having Cucurbitadienol Synthase Activity A collection or library of *S. cerevisiae* in-frame fusion polynucleotdies for a cucurbitadienol synthase gene (DNA coding sequence provided in SEQ ID NO: 907, and protein sequence provided in SEQ ID NO: 902) was prepared. The in-frame fusion polynucleotides were cloned into a yeast vector molecule to generate fusion proteins.

Various fusion proteins were generated and tested for cucurbitadienol synthase activities. The testing results for some of the fusion protein generated in this example are shown in Table 2.

TABLE 2

Cucurbitadienol synthase activities for the fusion proteins

| SEQ ID NO for fusion protein | Activity (as compared to the parent) | SEQ ID NO for fusion protein | Activity (as compared to the parent) |
| --- | --- | --- | --- |
| 1024 | 166% | 851 | 142% |
| 854 | 135% | 856 | 123% |
| 859 | 105% | 862 | 102% |
| 865 | 125% | 867 | 145% |
| 915 | 124% | 920 | 124% |
| 924 | 121% | 928 | 117% |
| 932 | 128% | 936 | 126% |
| 940 | 109% | 944 | 107% |
| 948 | 102% | 952 | 90% |
| 956 | 85% | 959 | 46% |
| 964 | 74% | 967 | 72% |
| 971 | 89% | 975 | 35% |
| 979 | 96% | 983 | 80% |
| 987 | 111% | 991 | 114% |
| 995 | 124% | 999 | 103% |
| 1003 | 118% | 1007 | 97% |

Example 68: UDP-Glycosyltransferases (311 Enzyme, SEQ IDs: 436-438) in the Presence of Mogroside IIIE, Mogroside IVE or Mogroside IVA to Produce Mogroside IV and Mogroside V Isomers Reaction conditions: To a 50 ml Falcon tube with 17 ml water, 3 ml of pH 7.0 1M Tris-HCl, 0.12 g UDP (Carbosynth), 3 g sucrose, 300 ul of protease inhibitor 100×M221, 150 ul of Kanamycin (50 mg/ml), 1.185 ml sucrose synthase Sus1 (1 mg/ml crude extract), 150 mg of starting Mogrosides, and 6 ml 311 enzyme (1 mg/ml crude extract) were added and incubated at 30° C., 150 rpm. The progress of the reaction was monitored periodically by LC-MS. After 3 days, the reaction was stopped by heating to 80° C. for 30 minutes with stirring (500 rpm). The reaction was then centrifuged (4000 rpm for 10 min, Eppendorf) and the supernatant was filtered through a 50 ml, 0.22 micron PVDF. The reaction products identified are depicted in FIG. 43.

Example 69: Production of Mogroside IA and/or Mogroside IE from Mogrol

Figure 45A:
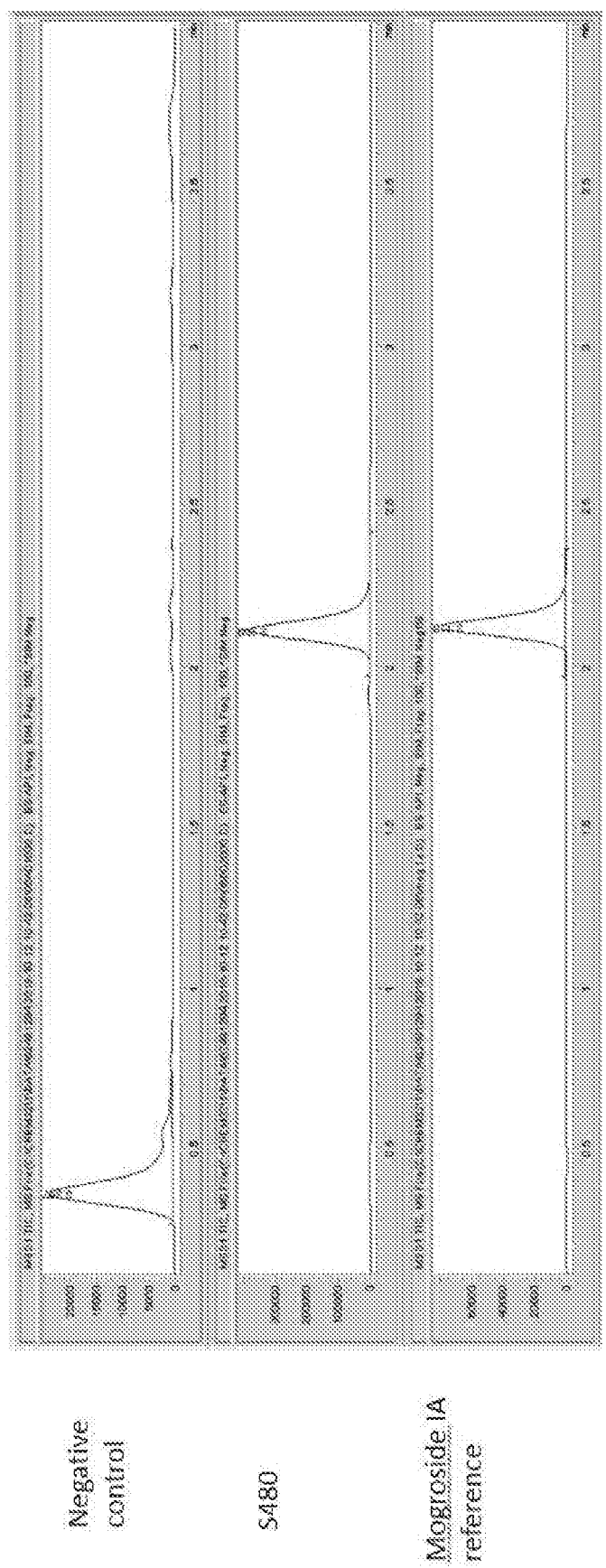
FIG. 45A shows production of mogroside IA.
Figure 45B:
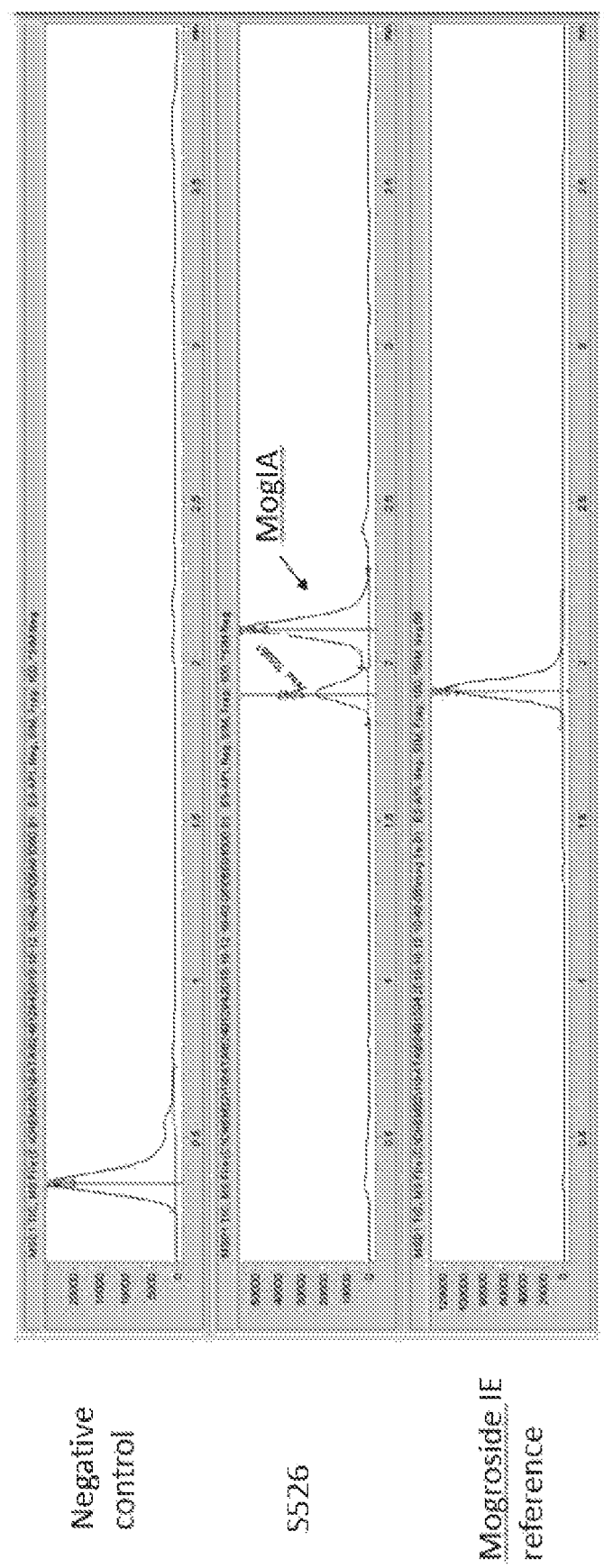
FIG. 45B shows production of mogroside IA and IE.

Various glycosyltransferase proteins were expressed in *S. cerevisiae* grown in the presence of 10 µM mogrol for 2-4 days at 30° C., 140-250 rpm in either shake flask or 96 well plates. Glycosyltransferases leading to production of Mogroside IA (glycosylation of C24-OH position) and/or Mogroside IE (glycosylation of C3-OH position) are provided in Table 6. DNA and protein sequences for the enzymes are provided in SEQ IDs 1050-1071 (see Table 1). Sample LCMS data are provided in FIGS. 45A-B.

TABLE 6

Enzyme displaying mogroside I production from mogrol identified by LCMS

| DNA/Protein SEQ ID NO. | Mogroside IA | Mogroside IE |
| --- | --- | --- |
| 1050/1051 | 2700609 | not detected |
| 1052/1053 | 1605 | 22917 |
| 1054/1055 | 659331 | 17857 |
| 1056/1057 | 200270 | 4690 |
| 1058/1059 | 261900 | 104300 |
| 1060/1061 | 696200 | not detected |

TABLE 6-continued

Enzyme displaying mogroside I production from mogrol identified by LCMS

| DNA/Protein SEQ ID NO. | Mogroside IA | Mogroside IE |
|---|---|---|
| 1062/1063 | 1816000 | not detected |
| 1064/1065 | 76330 | 13290 |
| 1066/1067 | 562100 | not detected |
| 1068/1069 | 1315000 | not detected |
| 1070/1071 | 1764000 | not detected |

TABLE 1

Some protein and DNA sequences disclosed herein

| Protein/DNA Description | Protein/DNA Sequence | SEQ ID NO | Accessio No./Reference |
|---|---|---|---|
| CYP8D18 DNA (codon optimized) [S. grosvenorii] | ATGTGGACAGTTGTGTTGGGACTTGCTACCTTGTTTGTTGCCTATTATATTCATTGGATCAACA AGTGGAGAGATTCCAAGTTCAAGTGTGTTCTACCTCCTGAACTATGGGCTACCATTGATAGG AGAGACAATTCAGTTGTCAAGACCATCTGACAGTTTGGATGTGCATCCCTTATCCAGAAGAAA GTCGAACGTTATGGTCCGATATTTAAAACCTGTTTGGCAGGCAGACCAGTTGTTGTTCAGCGG ATGCGAGAGTTCAATAATTACATTATGTTACAAGAAGGTAGAGCTGTAGAAATGTGGTATTTGA CACACTGTCTAAATTCTTCGGGTTGCGATACAGAGTGGTTAAAAGCCTTAAGCTTAATCCACAAG TACATAAGATCCATTACCCTAAACCATTTTGGTGCTGAAGCATTGAGAGAAAGATTCTTGCCAT TTATAGAGGCATCGTCTATGAAGCGTTACATTCTTGGTCCACTCAACCAGTGTGGAGGTCAA GAATGCAAGTGCTTTGATGGTATTCAGAACGTCTGTAAACAAGTGTTTGGAGAGATGCTAAG AAATTATCAGGAAATATTCCAGGTAAATTCACAAAGCTGTCATTGAATTTCTATCTCTACCGT ACGTGAAGTTGTAGATGATAGACTTGCCAATGTTGGCCAGATGTTGAGGACTTTCTAGGGCAA GCGTTGAAAGACAAAGAATCCGAGAAATTCATAAGCAAGAATTTATCATCCAATTGCTATTTT CAATAAGCTTGCTTCGTTCGAATCGATCAGCAGCGGTTGACATTGATTTTGAAAGCTACTTGA CGAACATCCTGAGGTTGTAAATTACCTGGGCAGGTTGTAAGCTATCAGAAAAGCTAGAGCT GATCCAGATGGTCCAATTACCTGGGAAGAATAACAAATTCATAAAATGCTTAATTACTAGAGCT ACGAAACACTTAGGTTAGGCTCAGTGACTCCTGCCTTATTGAGGAAACTGTTAAAGATCTGCA AGTCAAGGGTTACATTATTCCTGAAGGATGGACTATAATGTTGGTAACTGCATCTAGGCATCGT GATCCAAAGGTCTACAAAGATCCGCACATATTCAATCCTTGGAGATGGAAAGACCTAGGACTAAA TTACCATTCAAAAGAAGACTTTCTGTACTTTTCTTCACATTCTTCACAAATATAGGTGACGAAGTTA GGTGGCGGTAGAATTGCAAGAGCCCATATATTTTAAGTTTTGAAGATGGTTTGCACGTCAAGTTTA CTCCTAAAAGAGTAA | 871 | Itkins et al., 2016 |
| CYP8D18 Protein [S. grosvenorii] | MWTVVLGLATLFVAYYIHWINKWRDSKFNGVLPPGTMGLPLIGETIQLSRPSDSLDVHPFIQKK VERYGPIFKTCLAGRPVVVSADAEFNNYIMLQEGRAVEMWYLDTLSKFFGLDTEWLKALGLIHK YIRSITLNHFGAEALRERFLPFIEASSMEALHSWSTQPSVEVKNASALMVFRTSVNKMFGEDAK KLSGNIPGKFTKLLGGFLSLPLNPPGTTYHKCLKDMKEIQKKLREVVDDRLANVGPDVEDFLGQ ALKDKESEKFISEEFIIQLLFSISFASFESISTILTLILKLLDEHPEVKELEAEHEAIRKARA DPDGPITWEEYKSMTFTLQVINETLRLGSVTPALLRKTVKDLQVKGYIIPEGWTIMLVTASRHR DPKVYKDPHIFNPWRKDLDSIIIQKNFMPFGGGLRHCAGAEYSKVYLCTFLHILCTKYRWTKL GGGRIARAHILSFEDGLHVKFTPKE | 872 | Itkins et al., 2016 |
| SgCPR DNA (codon optimized) [S. grosvenorii] | ATGAAGGTCAGTCAGTTCATTCGAATTCATGTCCGCTATTATCAAGGGTAGAATGACCATCTAACT CCTCATTTGAATCTACTGGCTGATTGCTCCTCCGTTATCTTGAAACTCTTGAAAACAGAAATGGTTGCCAT CTTGACCACTTCTATTGCTTATTGCTGTTATGCGTTCATTGGATGGCTTCATGAACCAGAACCTGAAG TCTAGAAAGGTTAAGAATGTGGAAGAAGAGTTTCCATTCTTCCTGGTACTCAAACTGGTACTGCTGAAGGTTT GCTAAGGCTTGCGATGAAGCTAAAGCTAGATGATACGAAAAGGCTACCTTCAGAGTTTGTGAT TTGGATGAATTATGCTGCCGATGATGCTGCCTATCGATGGGATGGTGAACCTACTGATATATGCTGCTAGATTTCCAAGTG TTTCTCTTGTTGGCTACTTATGGTGGATGAGGAGGTGAATGGTTGCCAACACTTGCACTATGCTGTTTTGGTTTG GGTAACAGACAATACGAACACTTCAACAAGATTGCAGTATTGGATGACGATCAATGCATCGAAGATGATTT AAGGTGGTAATAGATTGGTTAAGGTTGTTAGGTGATGACGATCAATGCATCGAAGATGATGCT TTCTGCTTGGAGAGAATCTTTCGTGGGCCAGAATTGGATATGTGTTGAGAGATGAAGATGGAAGCTC ACTACTGTTACTACTCCATATACTGCTGAAGATAAGTCTTGGATTAACGCTAAGCTATGATCATCATTCTG CTGATGTGCTGCTGCAAGATAAGCTTGGATTAACGCTCATCATGCTGTTCATGATGCTCA | 873 | Itkins et al., 2016 |

TABLE 1-continued

Some protein and DNA sequences disclosed herein

| Protein/DNA Description | Protein/DNA Sequence | SEQ ID NO | Accessio No./Reference |
|---|---|---|---|
| SgCPR Protein [S. grosvenorii] | ACATCCATTCAGATCTAACGTTCTGTCTCAGAGAAGAATTGCATACTTCTGCCTCTGATAGATCC TGTTCTCATTTGGAATTCAATCATTCCGGTTCCCGTTTGAATTACGAACTGGTGATCATGTTG GTGTCTACTGTGAAAACTTGACTGAACACCGATAACGAAGATGTACTCCATTGGGTGTTGTCTCC AGAAACTTACTTCCTCTATCTACACCGATAACGAAGATGTACTCCATTGGGTGTTCTTCATTG CCACCACCATTTCCATCATGTACTTTGGCTTTGACGAACTGCTTTGACCAGATACCGCTGATTGTTGAACT CTCCAAAAAGTCTCTCTTGCTTCCAGGCTGGTAAAGATGAATATGCCCAATCTGTTATCGGTTCCCAA AAGTCTTTGTTGGAAGTTATGGCTGAATTCCCATCTGCTAAACCACCATTAGTGTTTTTTTTG CTGCTGTTGCTCCAAGATTGCAACCTAGATTCTACTCCATTTCATCCTCTCCAAGAATGGCTCC ATCTAGAATCCATGTTACTTGTCGTTTGGTTTACGATAAGATGCCAACTGGTAGAATTCATAAG GGTGTTTGTTCCACCTGGATGAAGAAGTATGTCGGCCGTTATTGCACAATCCAATGTTCTTGGG CTCCAATTTTCGTTAGACAATCCAATTTTAAGTTGCCAGCCGAATCCAAGGTTCCAATTATCAT GGTTGGTCCAGGTACTGGTTTGGCTCATCATTTGTTTTTCGGTTGCAGAACAGAAGAATGGATT ACATCACGAAGAATGAATTGAACAACTCGTTGAACACCGGTCTTGTCCGAATGGTTATTGC TTTTTCTAGAAGAGTCCTACCAAGAATACGTCCAACATAAGATGGCTGAAAAGGCTTCTGAT ATCTGGAACTGATTCTGAAAGTTGCTTACTTGTGTAAGGTTTGTGTGATGCAAAGTTCTTCCAAGCTA AGGATGTTCATAGAACCTTGCATACAAGGTCAAGAACAAGTTCTTAAGAGATGTTTGGTAA TGAATCCATGTCAAGAACTTGCAAATGGTAGATACTTAAGAGATGTTTGGTAA | 874 | Itkins et al., 2016 |
|  | MKVSPFEFMSAIIKGRMDPSNSSFESTGEVASVIFENRELVALLTTSIAVMIGCFVVLMWRRAG SRKVKNVELPKPLIVHEPEPEVEDGKKKVSIFFGTQTGTAEGFAKALADEAKARYEKATFRVVD LDDYAADDDQYEEKLKNESFAVFLLATYGDGEPTDNAARPYKWFAEGKERGEWLQNLHYAVFGL GNRQYEHFNKIAKVADELLEAQGGNRLVKVGLGDDDQCIEDDFSAWRESLWPELDMLLRDEDDA TTVTPYTAAVLEYRVVFHDSADVAAEDKSWINANGHAVHDAQHPFRSNVVVRKELHTSASDRS CSHLEFNISGSALNVETGDHVGVYCENLTETVDREALNLLGLSPETYFSIYTDNEDGTPLGSSL PPPPSCTLRTALTRYADLLNSPKKSALLALAAHASNPVEADRLRYLASPAGKDEYAQSVIGSQ KSLLEVMAEFPSAKPPLGVFAAVAPRLQPRFYSLSSSPRMAPSRIHVTCALVYDKMPTGRIHK GVCSTWMKNSVPMEKSHECSWAPIFVRQSNFKLPAESKVPIIMVGPGTGLAPFRGFLQBRLALK ESGVELGPSILFFGCRNRRMDYIYEDELNNFVETGALSELVIAFSREGPTKEYVQHKMAEKASD IWNLISEGAYLYVCCGDAKGMAKDVHRTLHTIMQEQGSLDSSKAESMVKNLQMNGRYLRDVW | | |
| CYP51G1 (codon optimized) [S. grosvenorii] | ATGGAACCTGAAAACAAGTTCTTCAATGTTGGGTTATTGATCGTAGTTACGTTCGTTTTGGCTA AACTAATTTCTGCGGTCATTAATTCCAGGTCTAAGAAGGAGAGTACCTCCAACCGTCAAAGGTTT TCCACCTTGTAGGTGGCTTGGTTAGATTTCTTAAAGGGCCAATTGTGAGAAGAAGAATAT CCCAAACAATGACCGTATTCACTCGAATTACTACATAAGAAGATTACCTTCTGATTGGAC CAGAAGTTCTGCACATTCTTTAAGGCTTCAGAGAGTCGTTTGATGTCGACAAGAGTCTACCA ATTTAACGTGCCCACTTCTTTACCGAAGCATTGAGAGTTTACAAAACTGAAGGCTATGTTGACCAAATGG TGAAAGACGAAGATTACTTTTCAAATGGGGTGAATTCAGGAGAGTTGATCTAAAATGCCAA ACTTGAACACTTGATGTAAGTGCCCCTATTTCATGACTTGGAATAACGTATGCTGCCAATATCCGTGA TTATTTGCTGATGTAAGTGCCCCTATTTCATGACTTGGAATAACGTATGCTGCCAATATCCGTGA TGTTCCCATACTTGTCAACATCATATCGTCGAATGTACATGACCACCTCTGAAAATGACATGTTACAA TGCTTTTATAAACTCTAAATCAAAGATGGCAGAACATACGAGCTCGATTCTGAAATCACAGGTAT GATAGCCGCATTATTCGCTGGGCAACATCGAGTCGGCCGTTCTTGAAGAGCAGCAGAAATCAGGAGAAG CATGGTGACGAAGCAGAATTACGATATTCTACCCAAAGGACATTTGTACCGTTGCATCAAAG AAGCCCTAAGACTACATCCACCCTTGATTATGCTTATGAGTCGAGTCATACCGATTTTAGCGT | 875 | Itkins et al., 2016 |

TABLE 1-continued

Some protein and DNA sequences disclosed herein

| Protein/DNA Description | Protein/DNA Sequence | SEQ ID NO | Accessio No./Reference |
|---|---|---|---|
| | TACGACAAGAAGAAAAAGAGTATGATATTCCGAAGGACAGATATTATTAGCACCAAGTCAGCT TTCGCAAATCGTTTACCTCACGTGTATAAAGACCCTGACAGATTTGATCCAGATAGGTTTGCTC CAGGTAGAGATGAGGATAAGGCTGCTGGACACTTTCCTACATATCATTTGGTGGTGAGACA CGGTTGTTTAGGTGAACCTTTTGCGTATTTACAAATCAAGGCAATCTGGTTCACACTTACTGAGA AATTTTGAGTTAGAGTTGATTAGTCCTTTCCCGGAAATTGACTGGAATCACCATGGTTGTGGGTG TCAAGGGTAAAGTGATGGTCAGGTATAAGAGAAGAAAGCTTAGCGTATCTTAG | | |
| CYP51G1 Protein [S. grosvenorii] | MEPENKFFNVGLLIVVLIVLLAKLLISAVINSRSKKRVPPTVKGFPLVGGLVRFLKGPIVMLREEY PKHGSVFTLNLLHKKITFLIGPEVSAHFPKASESDLSQQEVYQPNVPTFGPGVVFFDVDYSVRQE QFRFFTEALRVTKLLKGYVDQMVKEAEDYFSKWGDSGEVDLKCELEHLIILTASRCLLGREVRDQ LFADVSALFHDLDNGMLPISVMFPYLPIPAHRRRDQARSKLADIFVNIISSRKCTGTSENDMLQ CFINSKYKDGRPTTDSEITGLLIAALFAGQHTSSITSTWTGAYLLCHKEYMSAVLEEQQKQMEK HGDEIDHDILSEMDNLYRCIKEALRLHPPLIMLMRSSHTDFSVTTREGKEYDIPKGHIIATSPA FANRLPHVYKDPDRFDPDRPAPGRDEDKAAGPFSYISFGGGRHGCLGEPPAYLQIKAIWSHLLR NFELELIISPPPEIDWNAMVGVKGKVMVYKRRLSVS | 876 | Itkins et al., 2016 |
| CYP71B97 (codon optimized) [S. grosvenorii] | ATGTTATCGTTGGCCATTTGGGTTTCACTTTTGTTCTTGTTGTCATCATTGCTTCTTTTAAAGA CGAAGAAGAAAGTTGCTCCACTAAAAGAAGAAGAAGCAATTTCCACCTGGACCTCCCAAACTACC ATTGTTAGGCCATCGACTATATGGGTTCTTTTGCCTCATTGCCTCCTTATGTGAACTGTCTAGA AAATATGGTCTCTGTAGAGGTGTTGAAAGTACACGATCTAGACGATCGTCGTCCTCGAGATTGGCTGC TTCCGTAGATTCTCGTACAATTTCTGGATCTGAACTTGAAGCCCATATGTGAGAGATGGAGA GAACTGAGCAAAATTTGCGTATTGGTTTGCTAGGCTCTAGAGCGTGTCAGAGCTTCCAACAGA TAAGAAGAAGAGGTGGGATTATTACTTAAATCATTAGTCAAGTTCAGTAGTGCCACTCC AGTTGATCATCTGAGAAATCCTATTCTTTGACAGTAACAATTATCACAAGTCATCCAAGAGCATCGA AAGTCATTCCAGAGTGGCAATTAGACAATGAAGAACTTCTTCCTTCAGTAGGGTCGAATTATGACAGATT TGCCTTAGGTCCTTTCTGACAAACTTCTTTCCTTCCTTCAGTAGGGTCGGATTATCGACAGATATC AACCGGTGTACATGCAGATTGGAGAAGAGTTCTTGCCTAGATATAGACACCCTCTTCAGCATATC ATTGATGAATCGTATCAATTTGTCCGACAAGCCAAACCCAAACCGAAGAAAACATTATAGACGTACTAT TGAAATGGAAAAGAAGAACGTTCAAATTTTGATGTCTACAACTGAATAGGACTGCATAAAGC CTTGATAATGGATATATTTCTTGCCGGTTGAGATACTGGACAGGGACCAATTGTGTGGCATTG ACTGAATTGGTGAGAAATCCCAGATGCAGTGAAGAAGTTGCAAGACGAAATAAGGTCGTGTGA AAGAGGATCAAGTCAAGGAACGTGATTTAGAGAACTTCAGTACTTAAAGATGGTCGTTAAGA AGTTTTAAGATTGCATGCTCCAGTTCCTTTGTTATTGCCGAGAGAGAACAATGTCTCATTCAAA CTAAATGGTTATGACATTGATCCAGAAGAATTCTTCCAGAGATTCGCAGGATCAAGTATTGA ACCCGAGATTCTGGTCTGACAGAAGAATTTCTGAATTCGTGCCTATTGGTGGTGGCAGAACCTATTGT TTACAAAGACACATAATTTTGAATTGCTGCCATTTGGCTGGTGGCAGAACCTATTGTTTTGATTGGACTC AACATGGGACAGTTGCGGTTGAACTTGACTACAACGAACTATTACTTTGTTTTTGATTGGACTC TACCTGATGCGATGAAAGAGGAAGATGTTGACATGGAAGAAGATGGTGACTTGCTATTGCTAA GAATTCTCCCTAAAATTAGTTCCAGTTAGTGTCTTAATTAG | 877 | Itkins et al., 2016 |
| CYP71B97 Protein [S. grosvenorii] | MLSLAIWSLLFLLSSLLLLKTKKKVAPQKKKKQFPPGPPKLPLLGHLHLLGSLPHCSLCELSR KYGPVMLLKLGSVPTVVISAAAAREVLKVHDLACCSRPRLAASGRFSYNFLDLNLSPYGERWR ELRKICVLVLLSARRVQSFQQIREEVGLLLKSISQVSSSATPVDLSEKSYSLTANIITRIAFG KSFRGGELDNENFQQVIHRASIALGSFSVVNFFPSVGMIIDRLITGVHGRLEKSPAELDTFFQHI IDDRINFVATSQTEENIIDVLLKMERERSKFDVLQLNRDCIKALIMDIFLAGVDTGAGTIWAL TELVRNPRVMKKLQDEIRSCVKEDQVKERDLEKIQYLKMVVKEVLRLHAPVPLLLPRETMSHFK LNGYDIDPKTHLHVNWAIGRDPDSWSDPEFFPERFAGSSIDYKGHNFELLPFGGGRRICPGM NMGTVAVELALTNLLLCFDWTLPDGMKEEDVMEEDGGLAIAKKSPLKLVPVRCLN | 878 | Itkins et al., 2016 |

TABLE 1-continued

Some protein and DNA sequences disclosed herein

| Protein/DNA Description | Protein/DNA Sequence | SEQ ID NO | Accessio No./Reference |
|---|---|---|---|
| CYP73A152 (codon optimized) [S. grosvenorii] | ATGGATTTGCTTTTGTTGGAAAAGACGTTGTTGGGTCTATTATCGCTCGTATTGGCAATAG CCATTAGCAATTAAGGGGTAAAAGGTTTAAACTGCAACCAGGTCGTTACCTGTCCCTATCTT TGGCAACTGGTTACAGGTTGGTGATGAATTTGAACCACAGAAACTTAACGGTTTAGCCAAGAAA TTTGGGGATATTTCTTGTTAAGAATGGGCCAAAGAAACTTAGTGGTAGTTTCATCTCCTGAAC TTGCCAAGAAGTGCTTCATACACAAGGAGTTGGATCTAGAACAAGAAATGTAGTGTT CGACATATTACCGGAAAAGGTCAAGATATGGTTTTCACAGTATATGGTGAACATTGGGTAAA ATGCCTAGAATAATGACTGTACCATTCTTCACCAACAAGGTGTCCAACAATATAGGCATGGAT GGGAAGCAGAAGCAGCTAGCGTTGTTGAGATGTGAAGAAGAATCCGGAATCTGCTACTACTGG TATTGTGTTACGTCGTAGACTTCAATTGATGATGTACAATAACATGTATCGTATAATGTTGAC AGAAGATTTGAGTCCGAGGATGATCCCTATTTCACAAATTGCAGAGCACTGAATGGTGAGAGAT CTAGGTTGGCTCAATCGTTCGAGTACAACTATGGAGAACTTCATCCCTATTTTAAGACCTTTCTT GAGAGGCTATTTGAAAAGTAAGAAATTGCAAGGAAGTCAAGGACACTAGGTTACAGTTGTTTAAAATGTG CGATCGATCACATTCTGACGACCAAGACAGAAGGTGAAATCAAGATAACGTTTTATACAT TGTTGAGAATATTAATGTAGCTGCCATTGAAACTACGTTCGTGTCGATAGAATGGAATTGCA GAGCTTGTCATCATTCCTATCACTGAACCAGATACACATAAGTTGCCCTATTTACAAGCTGTCATAAAGA AACTCTTAGACTTAGAATGCTATACCTTGCTAGTTCCACATATGAATCTACATGATGCCAAA CTGGGTGGTTACGACATTCCAGCAGAATCCAAGATTCTAGTAAACGCTTGGTGGTTAGCCAATA ATCCAGCTAATTGGAAGAATTCAGAAGAATTCAGACCAGAGAATTCTTGGAAGAAGAGTTGTCCA AGTTGAAGCTAATGGAACGACTTTTAGATATTTACCGTTCGGTGTAGGAAGAAGGAGTTGTCCA GGGATAATTTTAGCCTCCAACTATCCTAGCTATCACCATAGGCAGACTGGTTCAGAACTTTGAAT TGTTACCTCCACAGGCAAAGTAAGCTGATACAAGTGAGAAGGTGGTCAGTTTCATTGCA TATTCTTAAACACTGTCAACCATTGTCGTTAAACCCAGGCATTTTAG | 879 | Itkins et al., 2016 |
| CYP73A152 Protein [S. grosvenorii] | MDLLLLEKTLLGLFIAVVLAIAISKLRGKRFKLPPGVLPVPIFGNWLQVGDDLNHRNLIGLAKK FGDIFLLRMGQRNLVVVSSPELAKEVLHTQGVEFGSRTRNVFDIFTGKGQDMVFTVYGEHWRK MRRIMTVPFFTNKVVQQYRHGWEARAASVVEDVKKNPESATTGIVLRRRLQLMNYNNMYRIMFD RRFESEDDPLFHKLRALNGERSRLAQSFEYNYGDFIPILRPFLRGYLKICKEVKDTRLQLFKDY FVEERKKLANVKTTNEGLKCAIDHILDAQQKGEINEDNVLYIVENINVAAIETTLWSIEWGIA ELVNHPEIQRKLRNEMDTVLGSGVPITEPDTHKLPYLQAVIKETLRLRMAIPLLVPHMNLHDAK LGGYDIPAESKILVNAWWLANNPANWKNPEEFRPERFLEEESKVEANGNDFRYLPFGVGRRSCP GIILALPILAITIGRLVQNFELLPPGQSKLDTSEKGGQFSLHILKHSTIVVKPRAF | 880 | Itkins et al., 2016 |
| CYP80C13 (codon optimized) [S. grosvenorii] | ATGTTAAAAGATCCCTTTGCTTTCCCTTTCACTCCTGTGAGTTTGGCTGTTCTTCTGTTCT TACTATTGAGAAGGATCTGCTCTAAATCTAAGCCTAGACCTTTGCCTCCGGTCCTACTCCATG GCCTGTGTCGGAAATCTATTGCAAATAGGCACAAATCCCATATTTCATCACTCAATTTTCT CAAACTTACGGTCCGTTCCGTTGATTTCCTTGCCGTTGGAACTAGCTTATTGGTCGTTGCATCGTCAC CAGCTGCTGCTGCCGTCTTCTTAGAACAGATAGAATTACTTAGTGCGAGACATATATGTTCCA GACGATTCCTGACAAACGTAAACATGCCCAATTGTCCTTATCCTATTCGCTAGCCATTGCGATGAC CATTGGAAGTCATTGAGAAGAGTAGAAAGAATGAAAGAGATTGGAATTTCTACAATCCAAACAAGGTAC AAGGAGGTCTTAGGAAGCTAGTGTTTACCACCGTTTCAACACTGTCTCTGAATCTGGTGTTC GGTTGTAGGTTGTTACGATGGCTATGTAGGTAAGGTTTCAATGGGATTAAGTCATCTTTTCACCGTT TCAAGAGACTTAGTTGGCTATGTAGGTAAGGTGAAGGTTTCAATGGGATTAAGTCATCTTTTCACCGTT CTATGAAATTAGGGTTAACCCTAATCTGGCAGACTTTTATCCAATACTGGAAGGGTCGATCT TCAAGAAAGGGAGGAATTACACAGGACAACAATTGGATTGTTCACCGAATGACTTCTTGGATG GTCAAGAAGGTAAGAATCAATTCAGTGATGATCAGATCAACTACTTGATTACTGATTACCGAGGCTCTACAGC TTTGATACAGAATCAATCAGTGATGATCAGATCAACTACTTGATTACTGATTACCGAGGTCTAACAGC | 881 | Itkins et al., 2016 |

TABLE 1-continued

Some protein and DNA sequences disclosed herein

| Protein/DNA Description | Protein/DNA Sequence | SEQ ID NO | Accessio No./Reference |
|---|---|---|---|
| | TGGTATTGATACAACCACTTCTACCGTTGAATGGGCTATGCGGAACTGTTAAAGAATAAGGAT<br>TTAACTGAGAAAGTCAGGGTCGAATTGGAAAGAAGATGAAAATCAAGAAAATGCGATTGATG<br>AGAGTCAAGATTAGTCAATTTCAGTTTCTTCAACAGTGTCAAAGAACTTTGAGACTTTATCC<br>ACCAGTGCCATTTCTGTTACCAAGACTAGCACCAGAACCTTGTGAAGTGATGGTTACAGTATT<br>CCGAAAGATACCTCGATATTTGTTAACGCATGGGCATTGCAATTCAGACTTGTAGACTCATGGAGG<br>AACCCTCAGCATTCCAAACCAGAAAGATTTGTCAATTCAACAGATTAGACTTTAAAGCCTATGATTA<br>CAGATTCTTGCCTTTTGCCTGGAGGGAGAGAGATCTTGTCCAGGCCTTTGATGAACAACTGTACAA<br>GTACCATTGATAATTGCCACGTTAATCCACAATTTGACTGGAGCCTACCTAATGGCGTGATT<br>TGGCCCAATTGGATTTAAGCGGTCAAATGGGTGTATCCTTACAAGGAAAGCCACTGTTGCT<br>TATTCCCAGGAAACGTACTTAG | | |
| CYP80C13 Protein<br>[S. grosvenorii] | MLKDPFCFPLPLLSLAVLFLLLRICSKSKPPRLPGPTPWVVGNLLQIGINPHISITQFS<br>QTYGPLISLRLGTSLLVVASSPAAATAVLRTHDRLLSARYMFQTIPDKRKHAQLSLSTSPFCDD<br>HWKSLRSICRANLFTSKAIESQGGLRRRKMKEMVEFLQSKQGTVVGVRDLVFTTVFNILSNLVF<br>SRDLVGYVGBGFNGIKSSFHRSMKLGLTPNLADFYPILEGFDLQGLQKKAVLYNKGVDSTWEIL<br>VKERRELHRNNLVVSPNDFLDVLIQNQFSDDQINYLITEVLTAGIDTTTSTVEWAMAELLKNKD<br>LTEKVRVELEREMKIKENAIDESQISQFQLQQCVKETLRLYPVPFLLPRLAPEPCEVMGYSI<br>PKDTSIFVNAWGIGRDPSIWEEPSAFKPERFVNSDLDFKAYDYRFLPFGGGRRSCPGLLMTTVQ<br>VPLIIATLIHNFDWSLPNGGDLAQLDLSGQMGVSLQKEKPLLLIPRKRT | 882 | Itkins et<br>al., 2016 |
| CYP92A127 (codon<br>optimized)<br>[S. grosvenorii] | ATGGAAGCTCCCTCTGGGTGTCTTATGCCGACAGCTTGGGTTGCAACATTGGCTCTATTGTTAC<br>TTAGTAGGCGTTTGAGAAGAAGAAATTGATTTGCCACCTGGACCTAAACCTGGTCCATTAAT<br>TGGCAATTTAAACCTAATAGGTTCTTTACCGACCATCAATCCATCAATTGTCCCAAAGTAT<br>GGCCCAATAATGACTTGAGATTTGGATCATTTCCTGTTGTAGTTGGCAGTTCTGTGATATGG<br>CCAAGATCTTCTTGAAAACTCAGAATTATGACAATTACGTGGTCACAATATGCTCCTATTGGAGACAAGCG<br>ATACCACCTTACAATTATAGCCAATGTCAATTGCTCTCTAGAAGAATTGGACAGTTAGAATACAATTAGGA<br>AGGAAAATGTGTTTGATGGAATGTCCTTGCTTAAGGAAATTGCAAGTAAATTCGGGAAGAAGTCATCAAACTAAA<br>GGACTACCTATCTACAGTTTCCTTGAACGTAGTCCAGACGAATTGATAAGCAGGATGGTCTTAGGGAAGAAATACACT<br>GACGAGTCAGAAGATGCAATCGTTAGTCAGACACATCGTGAGTGATTCGATACCGTGAGTGAATTGATTCTTAGATCTACAGG<br>TTACGTGAAACCGTATGAAAGCTTTGTCCAGAGAATTCGACAGATTTCTGAGCATGTTTTAGAC<br>GAGCATAATGAGAGAGAAAAAGGTCAAAGATTATGTAGCTAAAGACATGGTCCATGTACTGT<br>TACAACTGCAGATGATCCGGATCTTGAGTGAAGATTGGAAACGTCACGGTTGTTAAGGCGTTCAC<br>ACAAGACTTAATAGCCGGTGGTACAGAATCTTCCGCTGTCACTGTAGAATGGGCAATGAGCGAA<br>CTTCTAAAGAACCAGAAGATGTCGAAAAGGCCTCTGAAGATTAGATAGAGTGATTGGTAGGG<br>AAAGATGGGTTGAGGAAAAGATATCGCAATTACCCTATATGACGCAATTGCTAAAGAAAC<br>CATGAGGTTACATCCTGTGCACCAATGTTGGTACCTAGATTATGCAGAGAAGATTGTCAGATT<br>GCTGGCTACAGATATGCAAAGGGCACTAGAGTTCTTGTCAACGTTTTGGACAATTGGAAGAGATC<br>CAACTGTTTGAGAAATCCGGAGAATTTTAACCCAGAAGAATTTCTTGGGAAATCAATTGATGT<br>CAAAGGGCAAGACTTTAAAAGTTATTCAGTCATCACTGAATATGAAGAAGTATTCGGTTTAAGCACGCCAAAGAA<br>GTTCCTTTTGATGCTGTTGCCGAACCAAGACTGCCTCACACTGTATTCTATGTAG | 883 | Itkins et<br>al., 2016 |
| CYP92A127 Protein<br>[S. grosvenorii] | MEAPSWVSYAAAWVATLALLLSRRLRRRKLNLPPGPKPWPLIGNLNLIGSLPHQSIHQLSQKY<br>GPIMHLRFGSFPVVVGSSVDMAKIFLKTQDLTFVSRPKTAAGKYTTYNYSNITWSQYGPYWRQA<br>RKMCLMELFSARRLDSYEYIRKEEMNALLKEICKSSGKVIKLKDYLSTVSLNVISRMVLGKKYT<br>DESEDAIVSPDEFKKMLDELFLLSGVLNIGDSIPWIDFLDLQGYVKRMALSKKFDRFLEHVLD | 884 | Itkins et<br>al., 2016 |

TABLE 1-continued

Some protein and DNA sequences disclosed herein

| Protein/DNA Description | Protein/DNA Sequence | SEQ ID NO | Accessio No./Reference |
|---|---|---|---|
| | EHNERRKGVKDYVAKDMVDVLLQLADDPDLEVKLERHGVKAFTQDLIAGTESSAVTVEWAMSE LLKKPEMFKASEELDRVIGRERWVEEKDIANLPYIDAIAKETMRLHPVAPMLVPRLCREDCQI AGYDIAKGTRVLVNVWTIGRDPTVWENPDEFNPERFLGKSIDVKGQDFELLPFGSGRRMCPGYS LGLKVIQSSLANLLHGFSWKLAGDTKKEDLNMEEVFGLSTPKKFPLDAVAEPRLPPHLYSM | 885 | Itkins et al., 2016 |
| CYP92A129 (codon optimized) [*S. grosvenorii*] | ATGGAGGCACCACCCTGGGTTTCATATGCAGCTGCGTGGGTAGCAACATTGGCTCTGTTACTTC TGTCTAGACATTTGCGTAGAAGAAATTGAATTTCCAAGAAGGAAATTGAGACCGAAAGCCTTGGCCTCTAAT TGGCAATCTGAACTTGATAGGATCCGTACCACATCCATACATCAATTGAGTCAGAAATAT GGCCCAATTATGCAGTTAAGATTTGGTTCTTTTCCCGTGTTGTTGGTTCAAGCGTAGATATGG CCAAAATTTTCCTGACAAACACACGATCTTACGTTTGTGAGCAGACCGAAAACTGCTGCAGGCAA ATACACCACGTATACACTGTTCCAATATACTGGTCGCAATATGGTCCATATGGTCCATGTGGAGACAAGCC AGGAAAATGTGTTTGATGAGCGTGTTTAGCGCTAGAGATTTCATACGAATACATCAGAA AAGAGGAAATGAATTGTCTACTGTCTCGCTTATTGAAGGAGATTGCAAAAGTAGTGGGAAAGAAGTACACC AGACTATTTGTCTACTGTCTCCGCTTAATGTCATCAGTAGAATGGTCTAGGAAAGAAGTACACC GATGACTCTGAAGATGCCAATGTTTCTCCCGAAGATGTCAGTTAGAGAGCCATGTGTTAAGGCCGTTAC TACTGGGCGGTGTTTGAACATCGGTGATTCATACCTTGGATCGACTTCTTAGATCTTCAAGG ATATGTCAAGAGAATGAAGGCTTATGAAGGATTATGTGCTAAGGACATGGTCGATGTGTTAT GACAATCAACAGCGTAGAAAAGGTGAAGCCTAGAAGCGTGCATGCATGGTCTGATGTGTTAT TGCAATTGGCTGACCATCCAGATCTGGAAGTCAGGTTAGAGAGGCCATGTGTTAAGGCCGTTTAC CCAAGACTTGATTGCGAGAGGAACAGAATCATCCCAGTAACAGTAGAATGGGCCATGTCTGAA TTGTTAAAGATGGGTTGAAGAGAACAAGAACATTAGCCAATTTACCGTATATAGACGCCATCGCTAAAGAAAC CATGAGAATTGCCATCCAGTCGACCTATCCCACCTAGTTCCACGTTTATGCAGGAAGATTGTCAGATT GCTGATACATATTGCTAAGGGTACTAGAGTCTTGGTGAACGTTTGGACAATTGTAGGGATC CTACTGTATGGGAAAATCCTGATGATTATTGCCATTCGGATCAGGCAGAAGAATGTCCAGGGTACTCC CAAAGGTCAAGACTTCGAATTATTGTCCATTCGGATCAGGCAGAAGAATGTCCAGGGTACTCC TTAGGCTTAAAGGTTATACAGAGTAGCCTTAAGCAACATCTTTTGCCATGGTTTTCTCTTGGAGACTTG CTGGGGACGTTAAGAAGAGAATTTAAAACTGGAAGAGTTTGGTCTTTCTTACTCCCAAGAA ATTTCCATTGGATGCGGTTGCTGAACCTAGGTTACCACCTCACTTGTACTCTATTAG | 886 | Itkins et al., 2016 |
| CYP92A129 Protein [*S. grosvenorii*] | MEAPPWVSYAAWVATLALLLLSRHLRRRKLNLPPGPKPWPLIGNLNLIGSLPHQSIHQLSQKY GPIMQLRFGSFPVVVGSSVDMAKIFLKTHDLTFVSRPKTAAGKYTTYNCSNITWSQYGPYWRQA RKMCLMELFSARRLDSYEYIRKEEMNALLKEICKSSGKVIKLKDYLSTVSLNVISRMVLGKKYT DESEDAIVSPDEFKKMLDELFLLGGVLNIGDSIPWIDFLDLQGVVKRMKALSKKFDRFLEHVLD EHNERRKGVKDYVAKDMVDVLLQLADDPDLEVKLERHGVKAFTQDLIAGTESSAVTVEWAMSE LLKKPEMFKASEELDRVIGRERWVEEKDIANLPYIDAIAKETMRLHPVAPMLVPRLCREDCQI AGYDIAKGTRVLVNVWTIGRDPTVWENPDEFNPERFLGKSIDVKGQDFELLPFGSGRRMCPGYS LGLKVIQSSLANLLHGFSWRLAGDVKKEDLNMEEVFGLSTPKKFPLDAVAEPRLPPHLYSI | 886 | Itkins et al., 2016 |
| CYP92A458 (codon optimized) [*S. grosvenorii*] | ATGGAAATGTCATCATGTGTAGCCGCTACGATTAGCACTGGATGTGGTGTTTGTATTGTGG GTGTTGGATGGAGAGTTGGTAAATTGGGTTTGGCTAAGACCCAAGAAATTGGAGAAAAGGTTAAG GGAACAAGGCTTGGCAGGGAACTCTTACAGATTGTTATTGGTGACCTTAAAGAACGTGCAGCA ATGGCTGAACAAGCAATTCAAACCGATTAATTTTAGTCACGACATTGGTCCAAGAGTTCC CAAGTATGTAACAACCATCAGAATTATGGGAAGAATTCCTACATGTGGTTAGGTCCCTATCC AAGCGTCATTATAATGATCCACTGGTCAAATTCTTGTTAGATGGGATTGTCACTCATTCAA AAGCCGAATCGAATCCACTGGTCAAATTCTTGTTAGATGGGATTGTCACTCATGAAGGAGAAA AGTGGCAAAGATCATAGATCATTAATCAGCTTTTCACCTTGAAAGTTGAAGGACATGAT TCCTGCCTTCTTCGTGAACTTGTTATGCTTACTTGCAATGAGATAGTTAATGAGTGGGAAAGACTAATTCGAAGGAG GGTTCCTGTGAACTTGATGTTATGCCTTACTTGCAATGAGAACTAGCCTGATGCTATATCCAGAA | 887 | Itkins et al., 2016 |

TABLE 1-continued

Some protein and DNA sequences disclosed herein

| Protein/DNA Description | Protein/DNA Sequence | SEQ ID NO | Accessio No./Reference |
|---|---|---|---|
| | CAGCGTTTGTTCTAGCTATGATGAAGAGGGTAAAATGATATTCCAATTACTTAAGGAATTGACTGA TTTGTCTGTAAAAGTAGCGTTTGGTGTGTATATCCTGGTTGGTGGAGATTCTTACCAACCAAATCA AACACAAAATGAAAGAAATCAACAGGAAAATCAAATCTGCTATTAGAGAATCATTAACAAAC GTCAGAAAGCAATGGAAGAAGGCGAAGCTGGTCATCTGATTTGTTAAGCATACTAATGGAATC GAATTCCAACGAAATTCAAGGAGGAAGGAAAACAATAAGGAGGACTACAGCCAGACTATTAATTTGGA ATCGAGGAATGCAAGGTTTTCTATATAGGTGGACAAGAGACTACAGCCAGACTATTAATTTGGA CAATGATACTTTAAGTTCACATATGCAATTGCAAGAGAGCCAAGGAACTGAAGCTTGAAAGT CTTTGGCAATAAGAAGCCTGATTTTGATGGCTTGAACAGATTGAAAATCGTTAGTGAAATTCTA TAG | | |
| CYP92A458 Protein [S. grosvenorii] | MEMSSCVAATISIWMVVVCIVGVGWRVVNWVWLRPKKLEKRLREQGLAGNSYRLLFGDLKERAA MAEQANSKPINFSHDIGPRVFPSMYKTIQNYGKNSYMWLGPYPRVHIMDPQQLKTVFTLVYDIQ KPNLNPLVKFLLDGIVTHRGEKWAKHRKIINPAFHLEKLKDMIPAFFHSCNEIVNEWERLISKE GSCELDVMPYLQNLAADAISRTAFGSSYEGKMIFQLLKELTDLVVKVAPGVYIPGWRFLPTKS NNKMKEINRKIKSLLLGIINKRQKAMEEGEAGQSDLLGIIMESNSNEIQGEGNNKEDGMSIEDV IEECKVFYIGGQETTARLLIWTMILLSSHTEWQERARTEVLKVFGNKKPDFDGLNRLKIVSEIL | 888 | Itkins et al., 2016 |
| CYP88D6 protein [Glycyrrhiza uralensis] | MEVHVCMCAATLLVCYIFGSKFVRNLNGWYYDVKLRREHPLPPGDMGWPLMGNLLSFIKDFS SGHPDSFINNLVLKYGRSGIYKTHLFGNPSIIVCEPQMCRRVLTDDVNFKLGYPKSIKELARCR PMIDVSNAEHRLFRRLITSPIVGHKALAMYLERLEEIVINSLEELSSMKHPVELLKEMKKVSFK AIVHVFMGSSNQDIIKKIGSSFTDLYNGMFSIPINVPGFTFHKALEARKLAKIVQPVVDERRL MIENGQQEGDQRKDLIDILLEVKDENGRKLEDEDISDLLIGLLFAGHESTATSLMWSITYLTQH PHILKKAKEEQEEIMRTRLSSQKQLSFKEIKQMVYLSQVIDETLRCANIAFATFREATADVNIN GYIIPKGWRVLIWARAIHMDSEYYPNPEEFNPSRMDDYNAKAGTFLPFGAGSRLCPGADLAKLE ISIFLHYFLLNYRLERVNPECHVTSLPVSKPTDNCLAKVMKVSCA | 889 | KY499143, Zhu et al., Metabolic Engineering 45 (2018) pp. 43-50 ("Zhu et al., 2018) |
| CYP88D6 DNA [Glycyrrhiza uralensis] | ATGGAAGTACATTGGTTTGCATGCGCTGCCACTTTGTTGTATGCTACATTTTTGGAAGCA AGTTTGTGAAGAATTTGAATGGTGGTATTATGATGGTAAAACTAAGAAGACAACACCACT ACCCCCAGGTGACATGGGATGGCCTTCTTATGGGCCAATCTATTGTCCTTCATCAAAGATTTCTCA TCGGGTCACCCGATCCATTCATTCAACACACCCTTGTTCTCAAATATGGACGAAGTGGTATCTACA AGACTCACTTGTTTGGGAATCCAAGCATCCATTGTTTGCCGAGCCTCAGATGTGTAGGCGAGTTCT CACTCGATGATGGAACTTTAAGCTTGGTTATCCAAAATCTATCAAAGAGTTGGCACGATGTAGA CCCATGATTGATGTCTCTAATGCGGAACATAGGCTTTTTCGACGCCTCACTTACTTCCCCAATCG TGGGTCACAAGGCGCTAGACATGTACCTAGAACGTCTTGAGGAAATTGTGATCAATTCGTTGGA AGAATTGTCCAGCATGAAGCACCCCGTTGAGCCTTCCAATCAGGACGACATCATTAAAAAAATTGGAAGTTCGT GCCATTGTCCACGTTTTCATGGGCTCTCCAATCCAGGAGGATATTAGGGCTTTT ATGATAGAAAATGGTCAACAAGAAGGCGTAGCCAAGAAGGGGACATCTTATTGATATTCTTTTTGAAG ATGATAGAAAATGGTCAACAAGAAAATTGGAGGACGACAGATATTATTAATAGGGCTTTT TCAAAGATGAATTGGTGGAACTTTAAGCTTGCGCAGTTTAATGTGTCAATTACATATCTTCACAGCAT GTTTGCTGGCCATGAAAGTACAGCACCACCAGTTTAATGTGTCAATTACATATCTTACACAGCAT CCCATACTTGAAAAGGCTAAGGAAGCAGCAGAAGAGGAAGAAATAATGAGGACAAGATTGTCCTGC AGAAACAATTAAGTTTAAGGAACATTAAACAAATGGTTTATCTTTCTCAGGTAATTGATGAAAC TTTACGATGTGCCAATATTGCCTTTCAACTTTTCGAGGCAACTGCTGATGTGAACATCAAT GGTTATATCATACCAAAGGGATGGAGAGTTAATCCATCGAGATGGGATGATTACAATGCCAAGCAGG AATATTACCCAAATCCAGAGAATTAATCCATCCGAGATGGGATGATTACAATGCCAAGCAGG | 890 | Zhu et al., 2018 |

TABLE 1-continued

Some protein and DNA sequences disclosed herein

| Protein/DNA Description | Protein/DNA Sequence | SEQ ID NO | Accessio No./Reference |
|---|---|---|---|
| | AACCTTCCTCCTTTTGGAGCAGGAAGTAGACTTTGTCCTGGAGCCGACTTGGCGAAACTTGAA ATTTCCATATTTCTTCATTATTTCCTCCTTAATTACAGGTTGGAGCGACTAAATCCAGAATGTC AGTTACCAGCTTACCAGTATCTAAGCCACGACAATTGCCTCGCTAAGGTGATGAAGTCTC ATGTGCTTAG | | |
| CYPenzyme (coding DNA) [Citrullus lanatus] | ATGTGGACACAATTTGTTAGGTTTGGCTACGCTAGCTATGCTTACTACATACATTGGGTTAACA AGTGGAAAGATTCAAAATTCAATGGGGTATTGCCACCGGGGACGATGGGCTTCCGTTGATCGG TGAAACGATTCAACTTAGCCGTCCGTCCGATCTTCAAAACATGCTTAGCTGTCGTCCGGTTCACTG GTCAAAAGATATGGCCCGATCTTCAAAACATGCTTAGCTGTCGTCCGGTGGTCGTTCACTG ACGCCGAATTCAATCACTACCATCATGCTACAAGAGGGTCGTGCCGTGGAAATGTGTACTTGGA TACTCTTTCAAATTCTTCGGTTTAGACACGGATGCCTTGAAGGCCTTAGGCCTGATACATAAA TACATCAGGTCCATCACTTTGAACCACTTCGGAGCGGAATCCTTGCTGAAGAGGTTCTTCCTA GGATAGAAGAAAGCGCGTGAGACTTGTTCAGAACATCCATTATTGGTCGACCATCAGCCAGCCATCGTCGAGGTTAA GGAATCCGACGCTGGTGGTTTAACCAAGAAATTCACAGGTTTCTAGGTGGGTTCTTGACATTGC AAATTGCTGACTGGTGGTTTTAACCAAGAAATTCACAGGTTTCTAGGTGGGTTCTTGACATTGC CACTTAACTTACCGGGAACCACTTACAGTACCGGTAATGATCAAGGAAGAATCCAAAAGAA ACTTAAGGACATTCTGAAGAGAGTCCCAGCAGTTCATCTCCGAAGAATTCATCATTCAATTACTGT TCTCTATTTCCTTCGCTTCTTCGAAAGCATATCAACGAGTTTAACTCTGATTCTAAAGTTCCT TGCTGACCATCCGACAGTTGTCAAGGAACTTGAGCGTAGAGTATAAAAGCATGACGAGCAATCATTGAACGTTA GCCATCCAGATGGCCCTATAACTTGGGAAGAACTTCGATCGCCAGCTCTTCTAAGGAAGACTACCAAAGAAAT CCAGATCAAAGGTTACACCATTCCAGAGGGATGCGGTCATGTTGGTCATCCCTGAGGGCAC CGTGACCCCGAAGTGACAAGAGATCCGATACGTTTAATCCTTGGTGGCCTACGTCACTGCCGGGTGCTGA CTATTACCGTTCAGAAGAACTTTATGCCATTCCTTCATATTCTATTCACCAATATGATGGACAAAG ATACTCGAAGGATACCTATGCACGTTCTAGGCTAGAGCTCACATCTGCGTTTCGAGGATGGTTGCATGTGAAGT TGAAGGGTGCCAAGATAGCTAGAGCTCACATCTGCGTTTCGAGGATGGTTGCATGTGAAGT TTACCCCAAGGAGTGA | 1024 | |
| CYP enzyme (protein) [Citrullus lanatus] | MWTILLGLATLAIAYYIHWNKMKDSKFNGVLPPGTMGLPLIGETIQLSRPSDSLDVHPPIQSK VKRYGPIFKTCLAGRPVVVSIDAERFNHYIMLQEGRAVEMWYLDTLSKFFGLDTEWLKALGLIHK YIRSTLNHFGAESLRERFLPRIEESARETLHYWSTQPSVEVKESAAAMVFRTSIVKMFSEDSS KLLTGGLTKKFTGLLGGFLITLPLNLPGTTYNKCIKDMKEIQKKLKDILEERLAKGTGNDEDFLG QAIKDKESQQPISEEFIIQLLFSISFASFESISTSLTLILKFLADHPQVVKELEAEHEAIQKAR ADPDGPITWEEYKSMTFTLNVISETLRLGSVTPALLRKTTKEIQIKGYTIPEGWTVMLVTASRH RDPEVYKDPDTFNPWRWKELDSITVQKNMPFGGGLRHCAGAEYSKVYLCTFLHILFTKYRWTK LKGGKIARAHILRFEDGLHVKFTPKE | 1025 | Cla008354 |
| CYP enzyme (coding DNA) [Cucumis sativus] | ATGTGGACCATTCTTGGTTAGCTACTCTTGGCTACTCCTACTATATCCACTGGGTTAACA AATGGAAAGACTCTAAGTTTAACGGTGTTTTGCCACCAGGTACGATGGGCTTTGCCATTGATTGG TGAAACCATCCAATTGTCTAGACCATCCAATTCTTCAAGACTCTTTTGGCTGGTAGACCACAGTTGTTCTTCTACTG GTCAAAAGATACGGCCCAATTTCAAGACTGTTTTGGCTGGTAGACCACAGTTGTTCTTCTACTG GCTGAATTCAACCACTCATCATGTTGCAAGAAGGTAGAGCTGTTGAAATGTGGTACTTGGA TACTCTGTCTAAGTTTTCGGTTTGGATACCGAATGCCTTTGAAAGGCCTTGGGTTTGATTCATAAG TACATCAGGTCTATCACCTTGAACCACATTTGGTGCTGAAATCCTTGAGAGAGAAGATTCTTCCTA GAATTGAAGAATCCGCTAGGAGAACATTGCATTACTGGTCAACTCAACCAAACCTCCGTTGAAGTAAA AGAATTGTTGACTGGTGCTCTGCTATGGTTTCAGAACCTCTATCGTTAAGATGTTCTCCGAGGATTCTTCT AGTTGTTGACCGAAGGTTTGAACCAAGAAGTTCACTGGTTTGTTAGGTGGTTTTGACTCGC CATTGAATTTGCCAGTACAACTTACCATAAGTGCATCAAGTAAGTAAGGATATGAAGCAAGAAGAA | 1026 | |

TABLE 1-continued

Some protein and DNA sequences disclosed herein

| Protein/DNA Description | Protein/DNA Sequence | SEQ ID NO | Accessio No./Reference |
|---|---|---|---|
| | GTTGAAGGACATCTTGGAAGAAGAATTGGCTAAGGCTGTTAAGATCGACGAAGATTTTTGGGT CAAGCCATCAAGGACAAGAATCCCAACATTCATTCCGAATCATCCAGCTGTGT TCTCTATTCTGCCTTCCTTCGAATCTATTTCCTACTACTTGATCCTGAATTCTT GGCTGATCATCCTGATGTCCTATTACTTGGAAGAGCTAAGAGCTTATTACGAGCTAGA GCTGATCCAGATGGTCCTATTACTTGGAAGAGACTAAAGCTCATGAAGGAACATTCACTTGAACGTTA TCTGCGAAACCTTGAGATTGGGTTCTGTTCACTCCAGCTTGTTGTTGAAGACCACAAAAGAGAT TCAAATCAAGGCTACACATTCCTGAAGGTGACTGTTATGTTGCTTACTGCTTCTAGACAT AGAGATCCTGAAGTTTACAAGGATCCAGATACTTTTAATCCCTGGCGTTGAAGAGTTGGATT CCATTACTATCCAAAAGAACTTCATGCCATTTGTACTTCCTGCACATCTTGTTCACTAAGTACAGATGGCGTAAA ATACTCTAAGGTTTTACTTGTACTTCCTGCACATCTTTGTTCACTAAGTACAGATGGCGTAAA TTGAAAGGTGGTAAAATTGCTAGAGCCCATCTTGAGATTCGAAGATGGTCGTTAACT TCACCCCAAAAGAATGA | | |
| CYP enzyme (protein) [Cucumis sativus] | MWTILLGLATLAIAYYIHWVNKWKDSKFNGVLPPGTMGLPLIGETIQLSRPSDSLDVHPPIQRK VKRYGPIFKTCLAGRPVVVSTDAEFNHYIMLQEGRAVEMWYLDTLSKFFGLDTEWLKALGLIHK YIRSITLNHFGAESLRERFLPRIEESARETLHYWSTQPSVEVKESAAAMVFRTSIVKMFSEDSS KLLTEGLITTKKPTGLLGGFLTLPLNLPGTTYHKCIKDMKQIQKKLKDILEERLAKGVKIDEDFLG QAIKDKESQQFISEBFIIQLLFSISFASFBSISTTLTLILNFLADHPDVVKELEAEHEAIRKAR ADPDGPITWEEYKSMNFTLNVICETLRLGSVTPALLRKTTKEIQIKGYTIPEGWTVMLVTASRH RDPEVYKDPDTFNPWRWKELDSITTIQKNFMPFGGGLRHCAGAEYSKVYLCTFLHILFTKYRWRK LKGGKIARAHILRFEDGLYVNFTPKE | 1027 | Csa1G044890.1 |
| CYP enzyme (coding DNA) [Cucumis melo] | ATGTGGACCATACTATTAGGGCTAGCACCTTTAGCCATTGCCATTACATACATTGGGTCAACA AATGAAGGACTCAAAATTCAATGCGTTTTACCACCAGCACATATGGGCTTGCCGCTGATTGG TGAGACCAATTCAGCTTTCAAGACCAATTCTTTAAAACCTGTCTTGCCGAAGACCTGTCGTTGTGTCCACCG GTTAAAAGGTACGGCCAATCTTACATCACATGTCTCAAGAGGGTCGTGCGAAATGTGGTACTTAGA ATGCAGAATTCAATCACTACATCGTCTTTGGCTTAGACACTGAGTGGTGTGAAAGCTCTGATTCCAAA CACATTATCTAAGTTCTTTGCCTTAGACACTGAGTGGTGTGAAAGCTCTGATTCCAAA TACATCAGAAGTATCACTTTGAATCACTTCGGCTGCCGAATCCTGGTCGACATCAGCCATCAGTAGAGGTAAA GAATCGGACGCCATGGTGTTCAGGACATCAATTGTGAAAATGTTCTCTGAGGATTCGTCA AAGTTATTAACAGCTGGGCTGACGAAGAAATTTACTTGCTGTTGGGTGCTGTTTTTGACATTGC CCTTAAACGTTCCCGGGACAACGTACCACAACTATTAAGGACATGAAAGAGATACAGAAGAA ACTGAAGGACATACTTGAAGAGAATCTGCAAAGGGCTATCAATCGATGAAGACTTCCTTGGC CAGGCGATTAAGGACACAAAGAATCTGCAGCAGTTTATCTCCAAGAGTTTATCATTCAGTTACTAT TTTCCATACATCTTGCGAGTTTCGATTGCAGTTTCTACCACTTGACCTTGATCTTGAACTTCTT AGCGGACCATCCCGAGGCGCCATAACTTCCGTCTTGGTAGTGTTACACCAGCTCCTTTAAATGTGA GCAGATCCGAGACCTCGTCTTCGGTTGTTTACCAGCCGCTTTGTTATGCTAGTTACAGCCAGTAGACAT ACAAATAAAGCGTACACTATTCCTGAGGCTGGTACAGTTATGCTAGTTACAGCCAGTAGACAT AGAGATCCTTATTTGTGCAAGATGTACAAGGAACTTCATGCCCATTTGGTGCCTGAGGCACTGTGCGGGTGCAGA GTATCACCATACAGAGAACTTCATGCCCATTTGGTGCCTGAGGCACTGTGCGGGTGCAGA ATACTCGAAGTTCTATTTGTGCACATTCTTACACATATCTTAGATTCGAAGACGGCTTGTACGTAACT TCACGCCAAAAGAATAA | 1028 | |
| CYP enzyme (protein) [Cucumis melo] | MWTILLGLATLAIAYYIHWVNKWKDSKFNGVLPPGTMGLPLIGETIQLSRPSDSLDVHPPIQSK VKRYGPIFKTCLAGRPVVVSTDAEFNHYIMLQEGRAVEMWYLDTLSKFFGLDTEWLKALGLIHK YIRSITLNHFGAESLRERFLPRIEESARETLHYWSTQPSVEVKESAAAMVFRTSIVKMFSEDSS | 1029 | MELO3C002192P1 |

TABLE 1-continued

Some protein and DNA sequences disclosed herein

| Protein/DNA Description | Protein/DNA Sequence | SEQ ID NO | Accessio No./Reference |
|---|---|---|---|
| | KLLTAGLTKKFTGLLGGFLTLPLNVPGTTYHKCIKDMKEIQKKLKDILEERLAKGVSIDEDFLG QAIKDKESQQFISERFIIQLLFSISFASFESISTTLTLILNFLLADHPDVAKELEAEHEAIRKAR ADPDGPITWEEYKSMNFTLNVICETLRLGGVTPALLRKTKEIQKGYTIPEGWTMLVTASRH RDPEVYKDPDTFNPWRWKELDSITIQRNFMPFGGGLRHCAGAEYSKVYLCTFLHILFTKYRWRK LKGGKIARAHILRFEDGLYVNFTPKE | | |
| CYP enzyme (coding DNA) [Quercus suber] | ATGTGGACCAATAGGCTTGTGCATCTCGCCGTTTTGGTTATATACTTGAGCTATAGACTGAAATA AGTGGTCCAACCCAAGTGTAATGTACCCTGAGTCCTACCCCCAGGGTCAATGGGTTTGCCCATTAAATGG TGAACCCTGCAGTTAATTGTACCCTGTATTCCTAGACCTGCATCCTTTCATCAAGAAGAAA GCACAAAAGTACGGCCCAATCTTCAGGACTTCGGTAGCGGGTTCGCCAATCGTTGTTTCTATAG ATCCCGAACTTACATTACGTAAAGCAGAAGGTAGACTCGAGCTGTGGTATTTAGA CTCCTTCAGTAAGCTATTTCTACCGAAGGTGAAAATAAGACGAATTGGGGTTGTGCAT AAGTACATCAGGTTCTATCGCATTGAATCATTTCGGGGTGACCACTCAGTCACCTTTGGTTGATG CACAAATCGAAGAATTTGTTGACAAGGCTTTGACTTTTCAGCCAGCTATTCATTTCATATGATGCA GAAGCATGCCGCCAGCGTTATGATCTTGACTTTTCAGCCAGCTATTCATTTCATATGATGCA GAAAACAGCCCTATGAAAATGAGTGAAAAGTTCACCAAGTTCACCAAACATTTGGGCGATTCATGTCATTCC CCTGAACATTCCAGGCACCACCATTATCACAAGTGTCTAAAGGATAGAAATGAAGCCCTGAGTAT GTTGCGTAAGATCTTTAAGACGACCGGACAAGAAAAGTTCTCTCCTGAGGACTTCATAATCAACGTAGTGT CAGGCCATTAACGACGAGATTTTGAAAGATTCTCTCCTGAGGACTTCATAATCAACGTAGTGT TCGGTTTGTTGTCTTCATTCGAGTCCCATCGAGTCCTCTGTCGCTTATACTTAACCTATT GGCTGAGCACCCTAATTCCATTTGACTTGGGACTAGGAACTGACAGAGCGAACACAAGGCTATTCTGAAGAATAGG GAATCCTAATTCCATTTGACTTGGGACTAGGAACTGACAGAGCGAATCAAATCAATGACATTCACGCACCAGGTTA TAAATGAGGCTTTGAGGCTTGGCGGGCCTCCAGGCTTGCCTAAGAAGGCTTTAAAGGATAT CGAGTTCAAGGCTATACGACTCCCTGCGGCACCACTTGCCTTTAACCATGTTAGTAAACAGTGCCATTGA TTAAACCCAATACATATAAAGACCCACTTGCCTTTAACCCATGGAATGGAAGGACTTGGACT CGCTATTCGTCTCAAGACTTCCTTGCGCGACAAGTTCGTCAATGCGTTGGTGCCGA GTACTCAAAGACATTCCTTGCCAAGTTCTTCTTGTAACAAATATAGATGGACCAAG GTCAAGGTGCTACATCGTGCGTAACCCGATCTTGGAGTTCACTGACTGCTTCACATTAAAT TCTCTGCCATTCCAATTGA | 1030 | |
| CYP enzyme (protein) [Quercus suber] | MWTIGLCIVAVLVIYLSYRLNKWSNPKCNGILPPGSMGLPLIGETLQLIVPSYSLDLHPFIKKK AQKYGPIFRTSVAGSPIVVSIDPEFNHYIVKQEGRLVELWYLDSFSKLFSTEGENKINAIGVVH KYIRSIALNHFGVDPLKEKLLPQIEEFVDKALQTWSSHPLVEMKHAASVMIFDFSAKLFISYDA ENSPMKMSEKFTNILGGFMSFPLNIPGTTYHKCLKDRNEALSMLRKIFKERINSPKRHFEDLLD QAINDTDKEKFLPEDFIINVVFGLLFASFESISAALSLIINLLAEHPAVLQELTDEHKAILKNR ESPNSILTWDEYKSMTFTHQVINEALRLGGVAPGLLRKALKDIEFKGYTIPAGWTMLVNSAIQ LNPNTYKDPLAFNPWRWKDLDSLFVSKNFMPFGGGIRQCVGAEYSKTFLATFLHVLVTKYRWTK VKGGTIVRNPILEFTDGLHIKFSAISN. | 1031 | XP_023906874.1 |
| CYP enzyme (coding DNA) [Cucurbita maxima] | ATGTGGACCATTGTCTGTGGGCCTTGCAACACTTGCCGTGCCTATTACAACTCCATTGGATAAACA AGTGGAAAGACCCTCAGTTATCCAAGGCCTTCAATGGGTCTTGCCACCTGGAACCATGGGTTACCATTAATCGG AGAAACCCTCAGTTATCCAGGCCTTCGATTCTCTAGACGTTCATCCATTTATCAAGAAGAAA GTAAGAGGATACGGTTCATCTTTAAAACCCTGTTTGGGCCGGTCGTCCGTTGTTGTAAGTACGG ACGCCGAATTCAACAATTACATAATGCTTCAAGAGGGGAGAGCCGTTGAGATGTGGTACCTTGA TACCCTATCGAAGTTCTTCGGTCTTGATACTGAGTGCTAAGCCTTAAGCTTCATTCATAAG TACATAAGATCCATTACATTGAACCACTTTGGTGCTACTGGGCACTCAGCCTTCCGTTGAGGTGAA GGATTGAAGAGTCAGCTAGGAAACTTTATGCTCACTGGGCACTCAGCCTTCCGTTGAGGTGAA GGATTGAAGAGCGCAGCGCGTCATGGTCATCTCTAAGAGAACCATGGTCAAAATGGTATCGAAAGACTCCTCA AAATTGTTAACTGGTGGACTGACTAAGAACTTTACCGGGTTGCTAGGTGCTTCTTAACGTTGC | 1032 | |

TABLE 1-continued

Some protein and DNA sequences disclosed herein

| Protein/DNA Description | Protein/DNA Sequence | SEQ ID NO | Accessio No./Reference |
|---|---|---|---|
| | CCATTAACGTTCCAGGAACAACATACATAAGTAGTATGAAAGACATGAAGGAAATTCAAAAGAA<br>ATTGAGGGAGATCCTGGAAGGCAGATTAGCATCAGGTGCTGGTTCAGACGCAGGATTTCCTAGGA<br>CAGGCGGTTAAGGACAAGGGATCCCAGAAGTTCATTCAGACGACTTCATAATCCAGTTACTGT<br>TCTCTATCAGTTTTGCGAGTTTGAGTCCATCAGTACAACCCTTACATTAATCCTTAACTATCT<br>AGCCGACCACCCCGACGTCTGAAAGAGCTTGAGCGGACAATAGTCAAGCAATTAGGAACGGACGA<br>GCAGATCCCGACGGCCAATCACATGGAAGAGTATAAGTCATGACCTTCACTTTGCACGTAA<br>TCTTCGAGACCCTACGTTTGGCGCTACTGTTGACCAAGAGCTTGAGAAGACTGACGAAAGAGCT<br>GCAAATTAATGTTATATACTCCCGAAGGTTGGACGTAATGTTAGTGACCGCAAGCCGTCAT<br>AGGGATCCTGCTGTTTACAAGAACTTCATGCCATTTGGTGCGTCTTCGTCACTGTCTGGAGCTGA<br>GTATTCCAAGGTGTACTTATGCACACTTCTTGCATATTTGTTTCTACTAAATACAGGTGGACTAAG<br>TTGAAAGGCGCAAGGTTGCGCGTCGCCATATATTGTCCTTCGAGGATGCGTTGCATATGAAAT<br>TCACACCTAAGGAATAA | | CmaCh18G001160.1 |
| CYP enzyme (protein) [Cucurbita maxima] | MWTIVVGLATLAVAYYIHWINKWKDSKFNGVLPPGTMGLPLIGETLQLSRPSDSLDVHPFIKKK<br>VKRYGSIFKTCLAGRPVVVSTDAEFNNYIMLQEGRAVEMWYLDTLSKFPGLDTEWLKALGFIHK<br>YIRSITLNHFGAESLRERFLPRIEESAKETLCVWATQPSVEVKDSAAVMVFRTSMVKMVSKDSS<br>KLLTGGLTKKFTGLLGGFLTLPINVPGTYNKCMKDMKEIQKKLREILEGRLASGAGSDEDFLG<br>QAVKDKGSQKFISDDFIIQLLFSISFASFESISTILTLLLNYLADHPDVVKELEAEHEAIRNAR<br>ADPDGPITWEEYKSMTFTLHVIFETLRLGSVTPALLRKTTKELQINGYTIPEGWTVMLVTASRH<br>RDPAVYKDPHTFNPWRWKELDSITIQKNFMPFGGGLRHCAGAEYSKVYLCTFLHLFTKYRWTK<br>LKGGKVARAHILSFBDGLHMKFTPKE | 1033 | |
| CYP enzyme (coding DNA) [Cucurbita pepo] | ATGGAGATCATAAACGGAGTGTTCCTAATCTTGCCCCTGGGATTCGTCCTAGTATTCGAGGTGC<br>TTAAGAGATTGAATGCTTGCCCTTGTACTACGCCGTAAAATTGGGGAAGAAGTCGGGAGAATTACCACC<br>AGGCGACCTATCCTGGCCTTGTAGGATCTACAGAGTCCTGCTCAATTGTTAACCAGAAGAGACTAATG<br>CCACCAGAAGCTTTATAAGGAGCTTGATCTGTCGATTCTGTATGCAAACCAGAAATCTGTCGACCCAGGTTCGACCC<br>ATATGTTCGAAGAGCTTCGATTCGTAGTCGTACCCCGGTTGATGCAACCAGAAATCTGTCGACCATGTACAGACCC<br>CGAAACTAAGTTCGTCCCCGTTGACCCCGCTGTATGGAGAAAGTTGAGGAGAGATTGTTCGGCCGTAAAAGTTTA<br>ATCCGTGTATCGAAGGCCGAGCATGAAGAGTTGAGGAAGTTACCAGTCATTAGCCGGTCTTGAGGAGTG<br>GAGCTCCGTAGAAAAGCCATTAAAGCTGTTAACCAGGATTAAGGAATTGACATTCAAGATAATC<br>TGGAACATCTTTATGGCAGTACGTCATTGACTGTCAATTAACTTCACCACCAAAGGAAATGGAAGCCCTGTACG<br>ACGATGTGGCTTTGGGTTCTATTCTGTTTTCCAATTAACTTTCCAGGTTAACCAGAGAGACTAATG<br>CCTTAAGGCTAGGAAAAGATTGTACGAGATCCTGCTGTCAATTGTTAACCAGAGAGACTAATG<br>AAGAAATCCAAAGGTGGAGAGCTAAAGACTAAAGACATGAAGACATGATGATTTAATGACTGAGGTTGAGG<br>ATGAGGACGGCGAAGGCATGATAACGAAGCAATCACAGACTTGATATTTCGGAAGTTGTTCGC<br>TGGCCAGGAGCGTCCGCTTCACAATATGTGGGCAATCATATTTCTGACCGACCATCCCAC<br>ATCTTCCAGAGGCCAAAGAAGAACAGGAAGACATTATAAGGAGAAGGAGACAAGCACTCAAAAGG<br>GTATTAACCTGTCGAGTTCAAAACAGGAAATTCCTGTCCAAGTGAATAGATGAAACCCTAAG<br>GCTATCCAGCATTGCTTTTGCCACTTTGCAAGGTGCATCTTGTGGCACAGGGTTTATACATGGACGAAGAATTAC<br>TTAATACCGAAGGGTTGGAAGGTCATCTTGTGGCACAGGGTTTATACATGGACGAAGAATTAC<br>ATCCTTCCCCTCAAGACTTCAACCCATCGAGGTGGATGATTTCATCGGCAACCCTGGTGCATT<br>CACCCCGTTTGGGTTGGCGTTAGACTTTGCCCAGGACTTGGCCAAGTTGGAAATCAAGC<br>ATCTTCTTACACCCACTTCCCTCTTTACTAAAGATTGAAAAGGTATAATCCACAGTGCCAACTAA<br>CCTACCTGCCACTGCCACATCCTAAGGATAAATGCCTAGCTCGTGTTTTAAAAGCAGCAGGTCA<br>ATGTGTTGA | 1034 | |

TABLE 1-continued

Some protein and DNA sequences disclosed herein

| Protein/DNA Description | Protein/DNA Sequence | SEQ ID NO | Accessio No./Reference |
|---|---|---|---|
| CYP enzyme (protein) [*Cucurbita pepo*] | MEINGVFLILPLGFVLVFEVLKRLNGLYYAVKLGKKWGELPPGDLSWPLLGSTLSFLKSFTVG PPESPIRIFFTRYGKVDMYKTHMFGRASILVCKFEICRQVLIDETKFVPSYPACMKRLFGRKSL IRVSKAEHRKLRRMTMAPISSHAALEIYIEHTEHTVISGLEEWSVEKPKLLTEIKELTFKII WNIFMGSTSIDYTTKEMEALYDDVALGLFCFPINPPGFNFHKSLKARKRLYEILLSIVNEKRLM KKSKGESWEAKDMDLMTEVEDEDGEGMDNETITDLIFGKLFAGHETSAFTTMWAIIFLTDHPH IFQRAKEEQEDIIRRRPSTQKGINLVEFRQMKFLSQVIDETLRLSSIAFATFREATTDININGK LIPKGWKVILWHRGLYMDEELHPSPQDFNPSRWDFIGNPGAFTPFGLGVRLCPGRDLAKLEIS IFLHHFLLNYKIERYNPQCOLTYLPLPHPKDKCLARVLKAAGQCV | 1035 | Cp4.1LG14g08880 |
| CYP enzyme (coding DNA) [*Lagenaria siceraria*] | ATGGAGTTGATTATTAATAACTGGCTTCTAATTCTAAGCTGCGTTGGGTTCGCGTTGGGCCTAG GTGTTTTGAAGAGGTTGAATTACGCCATAAGGCTAGGCAAGAAGTTGGGAATGGAAGAAGT CCCACCGGGTGACTTGAGCTTGGCCTTTATTGGGCTCAACACTGTCCTTCATTAAGTATTTTACG CTAGGCCCACCGCACACATCTTCGAAGACATCTATTATTGTATGTAAGCCCGAAATTTGCAGGCAGGTGTT GACGGACGAAACGAAGTTGCCTCCAGGTTACCCAACGACATACATCATTGTTCGGCCGTAGA TCCTTGCATCGTGTCTCAAAAGTGGAGCACAGAAAGATTAACAACACGACTCCAATAA GTTCCACCGCAGCGTTGGAGTTGTATATCGATCATATAGAGCACACGTAATAATGAGTTGACGTTCAAA AGAGTGGTCATCTATGGAAGAAGCCCTTTGAAGCTTGATGATCTGGAAGAGATGAAGGAAGT ATCATATGGAATATCTTCAGACGGTCAATCGCCATCAGAGAGATGGAAG CTCTTTACAACGACACATTTCGCTAGGTTCTTTCTGCCTTCCGAAATCCTGCAGTGCATTGTGAACGAGAAG AGGTTAGTGAAGAAGTCCAAGGAGGAGAGACTTCACGGAAGAGCTAAAGATAATGATGACCTTATGATCG AAGTAAGACGCTAAGATGCCGAGGATGGCCATGACAGTATCCGTTGACCTAATATTCGAAA GTTATTCGCCGGGCAGGAAGAACGTCCGCTTTTACCACTATGGAGACGCTTCGTGTTAGTTCTATTACCT AATCCACACGTGTTCCAGAGGCCAAGTGAATGACTAAGCTAAAATCATACCAAAGGGTTG TCGAACTTTCCGTGAGGCAATGACTAAGGAATTGAACATGGAAGACGGAAGGTTGACCACCCTCCACAGGAA GAAAGTGATCTTATGCTAAGGGATAACTTCATAGGGAACCCCGGGACATTACCCCATTTGGGTTAG GCGTTAGAATGTGCCCCGGAGAATTTGCAAAGCTAGAATTTCCATATTTCCTCATTCCGATTCCC CTTGTTGAACTAACAAGGTGGAACAGCTGAATCCTCAATGCCAACTAGATTATCTACCGAATTCCCC CACCCTAAGGATAAGTGCCTAGCTAGGGTTCTAAAGGTTGCTTGA | 1036 | Lsi07G012220 |
| CYP enzyme (protein) [*Lagenaria siceraria*] | MELIINNWLLILSCVGFALGLGVLKRLNNLYYAIKLGKKWDEVPPGDLSWPLLGSTLSFIKYFT LGPPHNFIAQFSNRYGKVDMYKTHIFGRASIIVCKPEICRQVLTDETKFAPGYPTMTSLFGRR SLHRVSKVEHRKLRRLTTTPISSHAALELYIDHIEHTVINGLEEWSSMEKPLELLTVIKELTFK IIWNIFMGSTPMGSIAIREMEALYNDISLGFFCLPINPGFYFHKSLKARKRLHEILQCIVNEK RLVKKSKGETWEAKDMDLMIEVRDEDGEGMDDETIVDLIFGKLFPAGQETSAFTTMWAILFLTN NPHVFQKAKVIDETLRVSSITFATFREAMTDVKINGKIIPKGWKVILWLRELNMDEKLHTSPQE FNPSRMDNFIGNPGAFTPFGLGVRMCPGRDLAKLEISIFLHYFLLNYKVBQLNPQCQLDYLPIP HPKDKCLARVLKVA. | 1037 | |
| CYP enzyme (coding DNA) [*S. grosvenorii*] | ATGCTGAGCTTCCTAGGCTTTCGCGCTTCTCTTCTCTGTTCTTCCTAATTCACTCACTATTA AACTTTTCTGCTGCAGAGAAAAGCTGCCCTCCCCAGGTATGGGTTGGCCTATAT GGGCGAAACCCTCAGTTATATTCCAACAGACCCAATCTTGGATATCTTCGCTCATGCTAAGTTCTCCGAGG TACGACCAAATCTGTTGAGTTACCAAAGCCACTTCAAAGCCCACCTATTTAAACCAACAACTGGTCCCATTCGCTCATGCAAAGA CAGTCAAATTCGTGTTAGTTACCAAGCCACCTATTTAAACCAACAACTGTCCCTGCATCTAAGA GCGTATGCTTGGGAAGAACGCTATCTTCTTCCATCAGGAGACTACCACGCTAAGTTGCCTAGA CTTGTTTTGAGAGACTTCATGCCGAAGCCATGACTGATAAGGTACCATCGATGAAAGTATCG CTAAGAATACAGTTCAATCGTGGAAGGTCAGCTAGCTGATCAACACCCTTTCCAAGAGATGAAATGTT | 1038 | |

TABLE 1-continued

Some protein and DNA sequences disclosed herein

| Protein/DNA Description | Protein/DNA Sequence | SEQ ID NO | Accessio No./Reference |
|---|---|---|---|
| | TGCATTCGAAGTTTCTCTGCTTTCGGATCTTCGGCAAAGACGAAGCACTTTATTTCGAAGACCTG<br>AAGAGGTGCTATTACATCCTGGAAAAGGGCTACAAGGGCCAATAAATTTGCCAAGAACAT<br>TGTTCCATAAGGCGATGAAGGCAAGAAAAGAGTTAGCTCTATATTCTTAACAAGATCCTATCTAC<br>AAGACGTGAGATGATGAAACCGGACCACAACGACTTGCTGGGAGTTTATGGGGCAGAAGGAAGGT<br>CTTACTGATGAACAGATCGCTGACAATGTAATTGGGTTGATATTCGCCGCTAGAGATACTACCG<br>CTAGTGTCCTGACCTGGATACTAAAGTACTTGGGTGAAAACCCATCAGTTTTACAAGCAGTGAC<br>AGCCGAACAGGAAGCCATTATGAAGCAGAGGTCGGCTACCACAACCAGTGTGGGCGAT<br>ACTAAGAACATGCCAATCACTTCAAGAGTGATACAAGAGACCCTGAGAGTGGCAAGTGTGTGT<br>CCTTCACATTCAGAGAAGCTGTTGAGGATGTGAGTTTGATGGTTATTAATCCAAGGGATG<br>GAAAGTATTGCCTCTTTTCCGTAATATTCATCATCATTCACCAGAGATTTTCCCCCCAACCCGACAAG<br>TTCGACCGAGCCAGATTCGAAGTCGCCAAAGCCCAACAGTCCATGCCTTTCGGTTCTGGTA<br>CACACTCATGTCCCGTAATGAGTTGGCTAAACTTGAAATGCTTCTGCTATTGCATCACTTGAC<br>GACAAAGTACAGATGCCGTAGTTGGTGCGCAAGAGGGTATTCAGTACGGTCCCTTTGCTCTA<br>CCTCATAATGGGTTACCCATTAGGATCTCATTGAAGAAATGA | | Xia et al., GigaScience, 7, 2018, pp. 1-9 ("Xia et al., 2018") |
| CYP enzyme (protein) [S. grosvenorii] | MLSFLGFAAFFFCFPLIHSLFKLFSAARRKLPLPPGSMGWPYMGETLQLYSQDPNVFASKKKR<br>YGPIPKSHILGYPCVMLSSPEAVKFVLVTKAHLFKPTFPASKERMLGKNAIFFHQGDYHAKLRR<br>LVLRTFMPEAIRIMVPSIESIAKNTVQSWEGQLINTFQEMKMFAFEVSLLSIFGKDEALYFEDL<br>KRCYYILEKGYNSMPINLPGTLFHKAMKARKELAHILNKILSTRREMKPDHNDLLGSFMGQKEG<br>LTDEQIADNVIGLIPAARDTTASVLTWILKYLGENPSVLQAVTAEQEAIMKQKRSAHDNLTWGD<br>TKNMPITSRVIQETLRVASVLSFTFREAVEDVEFDGYLIPKGWKVLPLFRNIHHSPEIFPQPDK<br>FDPSRFEVAQKPNTYMPFGSGTHSCPGNELAKLEMLVLLHHLTTKYRWSVVGAQEGIQYGPFAL<br>PHNGLPIRISLKK | 1039 | |
| CYP enzyme (coding DNA) [S. grosvenorii] | ATGGAAGTGGAACTTACCAATTTCTGGGTCATGATTCTTGCCCGGTCTTTGGGCTTTGCGTAT<br>TTGTTTTCGGCTTCCTGAGACGTTTTAATGACCTTTGGACCATGGTAAAACTGGGAAGAAGGT<br>TTATAAACTTTACCGCTCCGGAGACCATGGGTTGGCCTTATTGCCTTCACTTGGTTCTAC<br>AAGGCCTTTCTGCATCCGGAGACCAGATTCTTTATTAAGCACTTTGCGTTCTAGATATGGTA<br>GAGTCGGGATGTATAAGACCCCATCTGTTCCGGTAAACCCGGTCCATTGTCACTGATCCCGAGAT<br>ATGCCGTCGTGTATATCTTGACGACAAGCACTTCGTAATGTCTTACCCAAAGTCGGTAAGATA<br>TTGGGTACTGGAAGTTTGTCTAGGATAGATCACCGTATCACACATAGGTTTATGCGCCTCCTA<br>TCAATGGTTCCGAGCTCTGGCGAGATATGTTGGTTTCATCGAGCAGTAGTAGTTGTAGGGCCT<br>AGAGGAATGGTCAAGTATGAGGAAGCCTATAGAGCTGTTGCATGAAATCAAAAGATTAACTTTC<br>AGAATTATATCCACGTTTCATGGCTGCCGTCTTCGTGGCCTTCCGGTCACGTGCCAGTTCCACCTA<br>TGTACGCTGAACTGTCTCTGGAGATGAAGGCTCAAAACATCCTAAGACCCGTAATCGAAGAAGAAG<br>TCACAGAGCTTTGAAAGCTAACAAGAACATGGGGTTTGGCCTTATTGCCTCTTCACTTGGTTCTAC<br>AGACGTATAATCGAAAAGAACGAGGAATGAAATGAAGATAAAATGTCAGTTGGACGCGTGTAATAAAAG<br>GTAAGAACGGCAAAGGGGAAAAGATCTTGCGACAACGACCAATCATTGATATGCTATTGGGGTT<br>GCTGTATGCAGGTCTATCACACACCTCTGCTCACGGTACCATGGGCCTTAATTCAACTTTTGAA<br>CACCCACAGGTTTATGAAAAGGCAGAAGAACAGAATTAATTATGAAACAACGTCCATCCA<br>CGCAGAAGGGGTTAATATTCAACGAAATCAAACAAATGACCTACCTTGTAAGGTCATTAATGA<br>GATGTTGAGGAGAGTGAGTATTGTTGTTCGCCAACTTCAGAGAGGCGGCCACGAGCGTTCATATGACC<br>AACGGCTATACCATCCGAATCCTGAAGAATTTAACCCTTCGGATACCCTGGGAACACCCAAGCC<br>CTCGAGATTTACCCGAATCCTACACCATTCTTATTGAAATATGTTTCTGCCCCGGAACAGAATTAGCAAACTG<br>GAATTACAATCCTACTACCACCATTTCTTATTGAAATATGTTTAAAATATGAACAGAATAACTGGCCAAGG<br>CCCTATTACAAGCGTTCCAATGCCCTCACCGATTGACCAGTGTTTAGCCAAGATAACTGCCAT<br>CCCATCCTCATAG | 1040 | |

TABLE 1-continued

Some protein and DNA sequences disclosed herein

| Protein/DNA Description | Protein/DNA Sequence | SEQ ID NO | Accessio No./Reference |
|---|---|---|---|
| CYP enzyme (protein) [S. grosvenorii] | MEVELTNFWVMILAAVLGFCVFVFGFLRRFNDLWTMVKLGKKVKTLPPGDMGWPLIGSSLWFY KAFSASGDPDSFIKHLRSRYGRVGMYKTHLFGKPAVIVIDPEICRRVYSDDKHFVMSYPKSVKI LGTGSLSRIDHRITHRFMAPINGSEALARYVGFIEQVVVRGLEWSSMRKPIELLHEIKRLTF RIIIHVFMGSALDPHIPKLEKLYAELSAAVEVAFAIDVPGSTYHRALKAKEEIQNILRPVIEEK RRIIEKNEEMEDKCQLDAVIKGKNGKGEKIFDNDAIIDMLLGLLYAGHHTSAHGTMWALIQLLE HPQVYEKAKEEQELIMKQRPSTQKGLIFNEIKQMTYLVKVINEMLRRVSIVFANFREAATDVNI NGYTIPKGWVVPVWIKGVHMDPQIYPNPEEFNPSRWDTHTPKPGAFIPFGNRFCPGNELAKL EITILLHHFLLKRYMERVNPKASITSVPMPSPIDQCLAKITAIPSS | 1041 | Itkins et al., 2016 |
| CYP enzyme (coding DNA) [S. grosvenorii] | ATGGCTATATTCTTCTTTCTTTCTTCTTCTTCCTACTGGTCGTGTCCGTTGTTTCGTTTCTAT TCTTAAGAGCTTCGCGTTTCCGTAGAGTTAGGTTGCCACCAGGTTCCCTAGGGTTACCGCTGAT TGGCCAGACCGCTACAATTGATTTCAGCATATAAGACGGAAAATCCAGAACCATTTATTGACGAA AGGGTGCGTAGATTCGGCGCCGTTTTATTCTACAGAACGAGGAAAAGCTGTTTGAACCTGTTTCAGCG CTGATTGGGAAACTACCGTTTATTCTACAGAACGAGGAAAAGCTGTTGAATGCTCTTACCC AGGCTCAATCAGTAACCTGTTGGCAAACATTCCCTGCTTATGAAGGTAACTTGCATAAG AGGATGCATTCTTAACTATGTCGTTCGCAAACTCCTCAATCATAAGGATCATTTGTTACTAG ATGTTGACAGATTGATAAGGTTGAACTTGAGCTGTGAAACAGTTGATGAGCTTTGACAGTGCCGAATGG GGCGAAGAAGATAACTTTGAGTTAGCTGTGAAACAGTTGATGAGCTTTGACAGTGCCGAATGG ACTCAGAACCTTATGAAAGATATTTACTGTCATAGAGGGTTCTTTACTGTACCTTTACCTC TGCTATCCACTACTATAGGCGTGCTATAAGGCGCAAGAACAAAAGTCGCTGAAGCTCTGGGTTT AGTCGTCAGACAACAAGACGTAAAGACTCAGACGAGCCAGGAGAAGAATGATATGTTGGGTGCT CTGCTTGCTGCTGAAGACGCATTATCAGACGACCAAATCTGGACTTCTTACTGGCTCTGTTGG TGGCAGAATACGAACACTACTAGTACCTTACAATGACTTGGCCGTTAAGTTCCTTACCGAGGCCCC ATTAGCCCTTACCCATTGCAAGAGAACATGACTATAAATCTATGCCTTTTACGACAATGCGTGGTAAACGAAACAC CAGCACTTGCAATGACTAATAATTCAGGCGTGTTTAGGCGTGCGATGACTGATATAAACATCAAGGG TTACACTATTCCCAAGGGATGGAAGTATTTGCTTCTTCTTTCAGGGCAGTTCATCTTGATCATGAT CACTTCAAAGACGCGCGTCGTGTTTAACCCTGGAGATGGCAACAGAACACATCTTGGATCAGGTCACAG TGAATGCCTTCACCCCTTTGGTGGTGCCCAGGCTTTGCCAGGTTACGAGTTAGCCCGTGT AGAGCTGTCAGTGTTCTTCCCAACCACCAGGACGCGAAAAGAATATCCCATAAGTTATGCGTAAGA ACGAAACCAGACAAGAAAGAATTCAATGACTGACTCAAGGCACATCAAGGGCTCAAGAGTCTTCTTT TGACATGTAG | 1042 | |
| CYP enzyme (protein) [S. grosvenorii] | MAIFFFFFLLVSVFVFLFLRASRFPRVRLPPGSLGLPLIGETLQLISAYKTENPPFIDE RVRRFPGAVFTHLFGEPTVPSADWETNRFILQNEEKLFECSYPGSISNLLGKHSLLMEGNLHK RMHSLTMSFANSSIIRDHILLLDVDRLIRLNLDSWTGRIFIMEEAKKITFELAVKQLMSFDRCEW TQNLMKEYLLVIEGFFTVPLPLLSTTYRRAIRARTKVAFALGLVVRQRRKESDAGKRKNDMLGA LLAAEDALSDDQIVDFLLALLVAGYETTSTTMTLAVKFLTEAPLALTQLQEEHBQIKARKKEAD QHLQWNDYKSMPFTQCVVNETLRVANIISGVFRRAMTDLINIKGYTIPKGWKVFASFRAVHLDHD HFKDARSFNPMRWQQNTSGSTVNAFTPFGGGPRLCPGYELARVELSVFLHHFVTQFSWVPAEDD KLVFPFTRTQKRYPINVMRKNETRQRKDSLDSRHMKGQESSFDM | 1043 | Xia et al., 2018 |
| CYP enzyme (coding DNA) [S. grosvenorii] | ATGGATGAATTAAAGTGGTTTGTCCTAATTCCAGCAACCTTCTTCTTAGTCGTTTCGTTTTCG AAGTTCTGAAGAGGTTGAACGGTTGTACTACGCTACAAAATTATGGAAGATATGGATGAGCT GCCGCCCGGGATATGGCTGGCCCCTGTTAGGGTCCACCCTTTCTTACATCAATGACTTTACA GCTGGCCAACCACAGAATTTCATCAGAACCTTTAGTAATGTATGGCAAGGCTGATATGTACA AAACTCACATTTTGGCCAGGCGTCTATAATCATCTGTACCAGAAATTTGCAGACAGGTCTT GACTAACGAGGATAAGTTCAAACCCAGTTTGCCTGCCACAGTGAAAATTCTTAGCGAAGAAAA | 1044 | |

TABLE 1-continued

Some protein and DNA sequences disclosed herein

| Protein/DNA Description | Protein/DNA Sequence | SEQ ID NO | Accessio No./Reference |
|---|---|---|---|
| CYP enzyme (protein) [S. grosvenorii] | TCATTGATGCAAGTTAGCAAGGCAGAACACCCGTAGATTAAGAAGGCTAACCATGCTCCTATTT CCGGACATGCTGCATTAGAAATGTACATCTCACATATACAGGCTACAATCTCCGCGACTGGA AGAGTGGGCTTCCATTCAAAGGCCTGTTGAGCTTGACCGAGATCAAGCGTCTGACATTCAAA GTTATATGAATATCTTTATGGGAAGCACTTCCTAGATTCGTCCATGGTGCCATGGAAGCCC TATTTTCGGACGTCGCTGTGGGCTTCCTATCATTGCCTATAAACTTCGATTATTCACGAAAAGCGT TAAATCTTTAAAGGCGGAGAAAGACTTATAGAGATACTTCAGTCTATTATCTAACGAAAAGCGT CTAGTTAAGAAGTCGAAAGCGAGACTCTGGAAGCAGATATATGAAGACCTGATGATCGAAG TGAAAGATGAGGACCGCGAGGAGCTGGACCGATGAGAGCTATCATTGATCTAATATTTGAAAATT GTTCGCCGGACACGAGACTTCCGCTTCACCCGCTATGTGGCTGTATTGTTCCTAACCGATCAT AGAAGGCTATTAACTTGTCAGACATGCAAGATGAAGTTCTTATCGCAAGTGATCGACGAAAC CTTAAGAGTCTCCTGCATAACCTCCGTGTTATTTAGAGAGGCGACTGCAGATGTCGAAATCAAT GGTAAGATAATTCCCAAAGGCTGGAGAGTTCAACCCTTCTAGGTGGGCAATGCTAGGACGAAAA ACTTGTTTCCCCGCCGCAGAGTTCAAACCTTCTAGGTGGGCAATGTTTGTCCCTAAACCAGG TGCTTTCATTCCATTCGGTGTGGGAACAGGTTCTGTCCTCGGGTCAGACCTAGCCAAGCTGGAG ATATCCATATTCCTGCCTTTTTCCTCACCCTACTGATAAGTGCTTGGCTAGGGTACAACAAGGTGGC TTAG | 1045 | Itkins et al., 2016 |
| | MDELKMFVLIPATFPLVVFVFEVLKRLNGWYYATKLWKIWDELPPGDMGWPLLGSTLSYINDFT AGQPQNFIRTFSNRYGKADMYKTHILGRASIIICTPEICRQVLTNEDKFKPSLPGNMKILSGRK SLMQVSKAEHRRLRRLTMAPISGHAALEMYISHIQATVVGGLEEWASIQRPVELVTEIKRLTFK VIWNIFMGSTSLDSSMGAMEALFSDVAVGFLSLPINFPGFYFHKSLKARKRLIEILQSIINEKR LVKKSKGESWEAKDMMDLMIEVKDEDGEEIDDETIIDLIFGKLFAGHETSAFTAMWAVLFLTDH PQIFPQKAKEEQEEIIRRPSTQKGINLSDYKQMKFPLSQVIDETLRVSCITSLLFREATADVEIN GKIIPKGWRVLPWLGMLYMDENLFPSPQEFNPSRWDNFVPKPGAFIPFGVGNRFCPGSDLAKLE ISIFLHYFLLNYKVERLNPKCHLTCLPFPHPTDKCLARVHKVA | | |
| CYP enzyme (coding DNA) [S. grosvenorii] | ATGGAACTTTGGCTGTGGTTGTTGGGTGCTTCTGTAGGCGCCATAACGTTTTCGTGTTCGTATAC TGAGAAACCTTAATCAGTGGAGATTTGTTACCAGACATAGGAACAGATACAACCTGCCACCCGG AGATATGGCTGGCCCTTATCGGAACATTGCTACCATTCCTTCAAGCTTTCAGAAGCCGTCGT CCCGACAGCTTATCAATTACTTCGCGTCCACATATGGTAAAATAGGTATGTACAAGACCTACC TGTTTGGTTCCCCATCGTCATAGTTTGCCTACCAGAAGTGTGCAGACACGTTTTGATGAACGA CGAACAGTTCGTGTTCGGAGTACAGTAGACATAGAAGCAACTAGAAGTCCTTACAGGATCAAAGGCTTTAAAC ACGTTTGTCGATATACATCGACAACGTTCGTCCAGTTAAGAAGATTGATAGCCTCGTGATATCCGGAACG ATCTATGAAGAAGCCTGTCCAGTTCCTGTCCGAGTGAAGTGAAAACCGTTGCTTTTAAAGTGCTTCT CACATCTTTATTGGCTCTACGAGCGCAGCCTTTATCGCCAAGATGGAGAAGCTTTATACGGACT TTCACTTAGGTTTCATGTCCACACAACTGCCAGGCACTGATTTGCCAGCACTGACTTGTTCACCTGCTTTGAA GGCGAGAAATGAGCTTATTAGAAATCTGAAACGTCTAAAGGAGGAAGGCCAATTTGAAG TCGAAGGAAGGCGAAATCTAAGATGGTTGTATTATTGACCCTACTATAGGTTTCTTCTCGCGATGAGG ATGCCAAGGCGTCGGCTCAGCCATCATCATGCGTGCAATAATGTTCCTAAGCGAGAATCCAGAAACATTG TTAAAGCTAAGCTGAACAGGAGACAAATCGTAAAGCGTAGACCTGCAGACGACCAACACAAAG GGTTGACAATGAAAAGATAAAGCAAATACTGGTTTACTCTAAGTGGAAACAAAGGTTGACGTAAGTGACAGCCAATGAAAGAGATAT TAAAACCAGCTTAGCTTTTACTCAAGTAGGAAACAAATGAGTACCTGAGTAAGGTTGACGTGAATGAATCTAAACGGATAC ACGATCCCAAAGGGCTGGAAGATTCGATGGTGATCCAGATGGTTTGGACAAGGAGTATAATTCCAAAGAAGGCCGGTAGCTT CATTCCGTTCGGGCTGGAATGAGACTATGCCCAGTAGTCGCCATATAGATCTATCCAAACTGGAAATAGCA | 1046 | |

TABLE 1-continued

Some protein and DNA sequences disclosed herein

| Protein/DNA Description | Protein/DNA Sequence | SEQ ID NO | Accessio No./Reference |
|---|---|---|---|
| CYP enzyme (protein) [S. grosvenorii] | ATTTTCTTGCACTACTTTATTATGGTGGCTTTAGGCTGCTGGAGAGGGTCAATCCTTAACTGCCCTG AGAACTATCTTCCGCTGGCCAGGCCTACGATAACTGCCTGCCCGTGTCGTCAGGGACTCATA G | 1047 | Itkins et al., 2016 |
| CYP enzyme (protein) [S. grosvenorii] | MELWMLLGASVGAYVFVFGILRNLNQWRFVTRHRNRYNLPPGDMGWPLIGTLLPFLQAFRSGR PDSFIHYFASTYGKIGMYKTYLFGSPSVIVCLPEVCRHVLMNDEQFVFGYSKAIRILTGSKALN TVPKAEHRRLRRLIASLISGNDALSVYIGHVEGIVINCLQEWGSMKKPVEFLSEMKTVAFKVLL HIFIGSTSAAFIDKMEKLYTDFHLGFMSTPIDLPGTTFSRALKARNELIRIFENVLKEKRANLK SKEGENRKKDMTDLLLEVRDEDGGQLDDGCIIDLLIGFFPAGHETSAHSIMRAIMFLSENPETL LKAKAEQEQIVKARPADDQHKGLITMKEIKQMEYLSKVIDETLRKTSLAFTLSRETKVDVNLNGY TIPKGWKILVWTRAVHMDPEIYESPQKFDPSRWDNSKRRAGSFIPFGAGMRLCPGIDLSKLEIA IFLHYFIYGGFRLERVNPNCPENYLPLARPTDNCLARVVRDS | 1048 | |
| CYP enzyme (coding DNA) [S. grosvenorii] | ATGTGGCTGTTGTTGTGATCGGTGCTATCGTTGTTGTTTGTCTTTGCACTAGATGGTTGTACGGTTGGA AGAATCCAAAGTGTAATGGTAAAATGCCACCAGGTCTATGGGGTTTCCATTATTGGGTGAAAC CTTGCAATTCTCTCTCCAAACACTTCTTCTGATGTTCCACCATTTGGTTGGTAGACCAGTTCTG AGATACGGTCCAATCTTCAGGACTAATTTGGTTGGTAGACAAGAGGTCAGTTGTTCCAATCTGGTATCCAGATACTTT CACCGAAATCTTCGGTAGACAAAACGTTGGTTCATTGCACGGTTTTATGTACAAGTACCTGAAG AACATGGTCTTGCATTGTTTGGTCCAGAATCCTTGAGAAAGATGATCCCAGAAGTTGAAGCTG CTGCTACTAGAGAAGATTTGATTGAACCGCCAAAAAGCTCATCTCATAACACCGTTGAATGAACGAAACCGC CTCTATGATGATCCTTCAGCTGGTGCCTCATCCAAGGTTCTACCAGGTTCTTTCCATTGAACCGTTCCAG AACTTGAGAGATAACTTCGTTGCCTCATCCAAGGTTCTGATTCTCTTTCCATTGAACCGTTCCAG GTACTGCTTATCATAAGTGCTTGCAGGTAGAAAAGCAACAAATTGACTTCTTCGACTTCGTCTTGAAGAG GCAAGAAAGAAGGCTAACCCAAGAAAGCAACAATTGACTTCTTCGACTTCGTCTTGAAGAG AATGGAAAAGATGGTACTTTGTTGACCGAAGAAATCGCCTTGACGGATTTGATGTTCGTTTGTT TGCCTTCTTTCGAAACCACTTCTTGCCTTGACTGCCATAAGTTTTGTTGTGATAACCC ACACGTTCTTTGGAGGAATTGACAGCTGAGTACAAACTATGACTTTCACCTTCACTTTCATCAACGAAACTG TCTGGTTTGACTTGGGGGTGAGTACAAACTATGACTTTCACCTTCCAGTTCATCAACGAAACTG TTAGATTGGCTAATATCGTCCCAGTGATTTTCAAAGGCTTTGACCAGCTGTTCATTTGAATCCAGAA AAGTACATTGATCCCCTTGGCTTTTAATCCTGGACGAATTCTGTTGGTACTCAAGGGTGTTTCACCAAGGT CCAAACATTTTATGGCTGTTTTCTTGCATTGCTGGTTGGTGGTATGAGATTCTGTGTTGGTACTCAAGGGTGTT TCAAATGGCTGTTTTCTTGCATTGCTGGTTACCAAGTACAGATTCAAGATTCAAGGCTATCAAGGTGGT AACATTATTAGAACTTCCAGGCTTGCAATTTCCAAACGGTTTCCATATTCAAATCACCGAGAAGT AA | | |
| CYP enzyme (protein) [S. grosvenorii] | MWLLLIGAIVVLSFTRWLYGWKNPKCNGKLPPGSMGFPLLGETLQFFSPNTSSDVPPFIRKRMD RYGPIFRTNLVGRPLIVSTDSDLNYFIFQQEQGQLFQSWYPDTFBIFGRQNVGSLHGFMYKYLK NMVLHFGPESLRKMIPEVEAAATRLRQWSSHNTVELKDETASMIFDLTAKKLISYDLESSSE NLRDNFVAFIQGLISFPLNVPGTAYHKCLQGRKRAMRMLKNMLQERRANPRKQQIDFFDFVLEE LEKDGTLLTEEIALDLMFVLLFASFETTSLALTAAIKFLLDNPHVLEELTAEHEGILKRRENAD SGLTWGEYKSMTFTFPQFINETVRLANIVPGIFRKALRDIQFKGYTIPAGWAVMVCPPAVHLNPE KYIDPLAFNPWRWEKSELNGASKHFMAFGGGMRFCVGTDFTKVQMAVFLHCLVTKYRFKAIKGG NIIRTPGLQPPNGFHIQITEK | 1049 | Xia et al., 2018 |
| Glycosylating enzyme (coding DNA) [Bacillus | ATGAGACATAAACATATCGGATTTTTAATATTCCGGCTCACGGCCATATTAATCCAACGCTAG CTTTAACGCCAAGCCTTGTCAAACGCGGTTATCGCCGGTAACATATCCGGTGACGAGTTTGT GAAGGCTGTTGAGGAAACTGGGGCAGAGCCTGCTCAACTACCGCGCTCAACTTAAATATCGATCCG | 1050 | |

TABLE 1-continued

Some protein and DNA sequences disclosed herein

| Protein/DNA Description | Protein/DNA Sequence | SEQ ID NO | Accessio No./Reference |
|---|---|---|---|
| licheniformis] | CAGCAAATTCGGGAGCTGATGAAGAAGTAAAAAAAGATATGTCGCAGGCTCCGCTGATGTTTATCA AAGAAATGGAGGAGGTTCTTCCTCAGCTTGAAGCTTATGAGGAATGACAAGCCAGACCTTAT CCTTTTTGACTTTATGGCCATGGCGGGAAAACTGCTGGCTGAGAAGTTTGAATAGAGGCGGTC CGCCTTTGTTCTACATATGCACAGAACGAACATTTTACATTCAGATACCATTCTGAAGAGTTTA AGATCGAGCTGACGCCTGAGCAAGAGGATGCTTTGAAAAATTCGAATCTTCCGTCATTTAACTT TGAGGATATGTTCGAGCCTGCAAAATTGAACATTGCTTTCTTTTGTGTCTTTTGCTTTCAGCCTTAC GGCGAAACGTTTGATGAGCGGTTCTTCTTTGTTGCGCCTTAACAGCTGAGCCAAACGCAAGTTCAGG AAAAAGAAACGCCGATTATTTCGACAGCGGCCGTCCTGGTCATGCTGATAATCTTTTAGGGACGGC GTTCATGCCTGGCCGACGAATTTTATCATATGTGCATAGAAGCATTCAGGGACACGAAGTGGCAG GTTATCATGGCTGTTGGCACGACAATCGATCCTGAAAGCTTTGATGACATACCTGAGAACTTTT CGATTCATCAGCGCGTTCCTCAGCTGAGATCCTGAAGAAGCGAGCTGTTCATCACCCATGG GGGTATGAACAGTACGATGGAAGGGTTGAATGCCCGTGTACCGCTCGTTGCCGTTCCGCAAATG CCTGAACAGGAAAATCACTGCCCGCCGCTGCAGAGCCGTCTCCAGACCGATGGTGACCCATGTCCT AAGCACACAGCAGCAGCTTCACTGCGGAAGCCCGTCTCCAGACCGATGGTGACCCATGTCCT GAAACGGATACAGCAGCTTCACTGCGGAAGCCCGTCTCCAGACCGATGGTGACCCATGTCCT GAAACGGATACAGCACATGCAGAAGCACATTAACACAGCCGAGGGCCGAGAAGCCGAGAT GAAATTGAGGCATTTTAGCACACCCCCAGGAGTAAAATAA | | |
| Glycosylating enzyme (protein) [Bacillus licheniformis] | MRHKHIAIFNIPAHGHINPTLALTASLVKRGYRVTYPVTDEFVKAVEETGAEPLNYRSTLNIDP QQIRELMKNKKDMSQAPLMFIKEMEEVLPQLEALYENDKPDLILFDFMAMAGKLLAEKFGIEAV RLCSTYAQNEHFTRSISEEFKIELTPEQEDALKNSNLPSFNFEDMFEPAKLNIVFMPRAFQPY GETFDERFSFVGPSLAKRFQEKETPIISDSGRPVMLISLGTAFNAWPEFYHMCIEAFRDTKWQ VIMAVGTTIDPESFDDIPENFSIHQRVPQLEILKKAELFITHGGMNSTMEGLNAGVPLVAVPQM PEQEITARVEELGLGKHLQPEDTTAASLREAVSQTDGDPHVLKRIQDMQKHIKQAGGAEKAAD EIEAFLAPAGVK | 1051 | WP_003182014 (Pandey et al., 2014) |
| Glycosylating enzyme (coding DNA) [S. grosvenori] | ATGGAGAAAGGCGATACGATATTCTAGTTGTTTCCTTTCCCTTCACAAGGCCACATAAACCCTC TTCTTCAACTATCGAAGCCGCTAATCGCCAGGGAATCAAGTTTCGCTGGTCACAACCTTACA TGTTAGCAATCACTTGCAGTTGCAGGGTGCTTATTCCAACCGTGAAGATCGAAGTCATTTCC GATGGCTTCTGAGGATCGTCTGGAAACCGATACTATGCGCCAAACTCTGGATCGATTTCGGCAGA AGATGACGAAGAAGTTGGAAGATTTCTTCCAGAAAGCCATGGTTTCTTCAAATCCGCTAAATT CATTCTATGATTCGACAATGCCCTGGGTTTGCAGCCTTAACAGTATCATTATCATGTTCTTCATGGTCAAT GCCCCGTTCTACACACGTCTTGTGCCTTAACACTCATCAATTATCATGTTCTTCATGGTCAAT TGAAGCTTCCTCCCACGATTTCGTTGCCTTCGATCACCATCATCGATCTTCTTACCAGTCAG TCTCCCGGCTTATGATTTTGATCCTGCCTCACCTGACACCATAACACTTTTGACAAGTTGGAAGGCGAGA TATTCTAATATCCAGATGAGAACCTGCTGCCCGTGTGAAAACCGTAGGACCAACTGTTCATCAGC CTACTTAGACAAAAGGTAGAGACAGCAACACAGCACTATGGGCTGAGTCTGTTCAAGCCCAACGAG GACGTCTGCCTCAAATGGCTTGATAGCAGCTGAAGGAGAAGCAACCCCTCGGTTCTGTTCTGTTCTATGGCA GTTCTCTTGTGGGTGGCAGAGCTTGGCTTCCCAGCTGAAGGAGTTGGCTCTCCAGCTGTGGAAGCTTCCTCCCAACTTTGTGAGAGT GTGGCAGAGAGGGGCTTGTGTGGTCAGCTGGTGCTCCCAGCTGCTTGAGGCGCGTGTGCTTGGAAGATGTTGG TCGGCTGCTCTTCTCACGCACTGCTGGCTGGACTGTGGGCTGATCAGGTAACCAATGCAAGTTTGGCTCTTGGGCGTCC AGGTTGGGAAGGGGGCTGGAATGACGAATGACGCAGAGCCTGCAAGTAAAGAAGAAGTAAGGAGTT GCATTTGGGAAGTGATGAGGAGAGAGCCAGCAGTTCAAGAGCAACTCATGAGTGAA GAAGTGGGCAAAAGAAGCTGTGATGAAGGTGGAGGCTCTGATAAGAACATTGAGGAGTTTGTG GCCATGCTCAAGCAACTTGA | 1052 | |

TABLE 1-continued

Some protein and DNA sequences disclosed herein

| Protein/DNA Description | Protein/DNA Sequence | SEQ ID NO | Accessio No./Reference |
|---|---|---|---|
| Glycosylating enzyme (protein) [*S. grosvenori*] | MEKGDTHILVFPFPSQGHINPLLQLSKRLIAKGIKVSLVTTLHVSNHLQLQGAYSNSVKIEVIS DGSEDRLETDTMRQLDRFRQKMIKNLEDFLQKAMVSSNPPKFILYDSTMPWVLEVAKEFGLDR APFYYQSCALNSINHVLHGQLKLPPETPTISLPSMPLLRPSDLPAYDFDPASTDIIDLLTSQ YSNIQDANLLFCNTFPDKLEGEIIQWMETLGRPVKTVGPTVPSAYLDKRVENDKHYGLSLFKPNE DVCLKWLDSKPSGSVLYVSYGSLVEMGEEQLKEALGIKETGKFFLWVRDTEAEKLPPNEVES VAEKGLVVSWCSQLEVLAHPSVGCFFTHCGWNSTLEALCLGVPVVAFPQWADQVTNAKFLEDVW KVGRVKRNEQRLASKEEVRSCIWEVMEGRASEFKSNSMEWKKWAKEAVDEGGSSDKNIEEFV AMLKQT | 1053 | AEM42999 (Dai et al, Plant Cell Physiol. 56(6): 1172-1182 (2015), "Dai et al., 2015") |
| Glycosylating enzyme (coding DNA) [*Barbarea vulgaris*] | ATGGTTTCCGAAATCACCCATAAATCTTATCCTCTTCACTTGTTCTCTTCCCTTTCATGGCTC AAGGCCACATGATTCCATGTTGATATTGCAAGGCTCTTGGCTCCAGCGCGGTGAAATAAC AATTGTCACAACGCCGCACAATGCAGCGAGGTTCGAGAATGTCCTAAGCCGTGCCATTGAGTCT GGCTTGCCCATCAGCATAGTGCAAGTCAAGCTTCCATCTCAAGAAGCTGGCTTACCAGAAGGAA ATGAGACTTTCGATTCACTTGTCTCGATGGAGTGCTGGTACCTTTCTTTAAAGCGCTGTAACAT GCTTGAAGAACCGGTCCAGAGACTCTTTGAAGAGATGAGCCTCAGCAAGCTGTATAATTTCT GATTTTGTTTGCCTTTATACAAGCAAAATAGCCAAGAAGTTCAATATCCCAAAGATCCTTCC ATGGCATGTGTCTTTTGTCTTCGTGATGCATGTTTCCTATTTCCTGATCGAGTTGAATTCACA AGACCTCAAGTTCCAATGGCAACATATGTTCCTGGAGAGTGGCACGAGATTCAAGGAGGATATAG TAGAAGCCGGATAAGACTTCCTATGGTGTGATAGTCAACACATATCAAGAGCTCCAGCCTGCTTA TGCCAACGACTACAAGGAGGCAAGGTCTGGTAAAGCAAGCAGAGGGAACAGCAGCATTGATCAAGATGAGTGTC AACAAGGTGGGAGCCGACAAGAGCAGACAGAGGGGTTCGTTCTATATGTTTCCTTGAAGTATCTGCAG TTAAATGCTGATTCTAAAGAAGAAGTTCGGTTCTAATTGTGCTTAGGCCCTCCAAAGACCTTCATT TGGGTCGTAAGAGGTTGGAGAAGACAGGGCTTCTTAACACTGTGGATGGAACCAAATCTGCAACGAATGAATCCTGC ACATCATTCCGTTGGAGGGTTCTTAACACTGTGGATGGAACCAAATCTGCAACCAAAACTGTCG TCAGGCATTCCATTGCTCACTTGGCCACTTCATCTCTAAATCACCTTGCTAGAAGCACATATGCAACTAGC ACAATCTAATAATTGA | 1054 | |
| Glycosylating enzyme (protein) [*Barbarea vulgaris*] | MVSEITHKSYPLHFVLFPMAQGHMIPMVDIARLLAQRGVKITIVTTPHNAARFENVLSRAIES GLPISIVQVKLPSQAGLPEGNETFDSLVSMELLVPFKAVNMLEEPVQKLFEEMSPQPSCIIS DFCLPYTSKIAKKFNIPKILFHGMCCFCLLCMHVLRKNREILENLKSDKEHFVVPYFPDRVEFT RPQVPMATVPGEWHEIKEDIVEADKTSYGVIVNTYQELEPAYANDYKFARSGKAWTIGPVSLC NKVGADKAERGNKADIDQDECLKWLDSKEEGSVLYVCLGSICSLPLSQLKELGLGLEESQRPFI WVVRGWEKNKELLEWFSESGFEERVKDRGLLIKGWSPQMLILAHHSVGGFLTHCGWNSTLEGIT SGIPLLTWPLLFGDQPCNQKLIVVQVLKVGVSAGVEEVTNWGEEEKIGVLVDKEGVKKAVELMGE SDDAKERRKRVKELGQLAQKAVEBGGSSHSNITSLLEDIMQLAQSNN | 1055 | AFN26667 (Plant Physiology, December 2012, vol. 160, pp. 1881-1895, "Augustin et al., 2012") |
| Glycosylating enzyme (coding DNA) [*Barbarea vulgaris*] | ATGGTTTCCGAAATCACCCATAAATCTTATCCTCTTCACTTGTTCTCTTCCCTTTCATGGCTC AAGGCCACATGATTCCATGTTGATATTGCAAGGCTCTTGGCTCCAGCGCGGTGAAATAAC AATTGTCACAACGCCGCACAATGCAGCGAGGTTCGAGAATGTCCTAAGCCGTGCCATTGAGTCT GGCTTGCCCATCAGCATAGTGCAAGTCAAGCTTCCATCTCAAGAAGCTGGCTTACCAGAAGGAA ATGAGACTTTCGATTCACTTGTCTCAACAAGTTCTGTGAACATGTTGGATGCGGTTAACAT GCTTGAAGAACCGGTCCAGAGCTCTTTGAAGAGATGAGCCCTCAGCCTTCTTTAAGCGGTTAACAT | 1056 | |

TABLE 1-continued

Some protein and DNA sequences disclosed herein

| Protein/DNA Description | Protein/DNA Sequence | SEQ ID NO | Accessio No./Reference |
|---|---|---|---|
| Glycosylating enzyme (protein) [Barbarea vulgaris] | GATTTTTGTTTGCCTTATCAAGCAAAATCGCCAAGAAGTTCAATATCCCAAAGATCCTTCC ATGGCATGTGTGCTTTGTCTTCTGTGCATGTTTACGCAAGAAGCCGTGAGATCTTGGA AAACTTAAAGTCTGACAAGGAGCATTTCGTTGTTCTTATTTCCTGATCGAGTTGAATTCACA AGACCTCAAGTTCCATTGGCAACATATGTTCCTGGGAATGGCACGAGATCAAGGAGGATATGG TAGAAGCGGATAAGACTTCCTATGGTGTGATAGTCAACACATATCAAGAGCTCGAGCCTGCTTA TGCCAACGGCTACAAGGAGGCAAGGTCTGGTAAAGCATGGACCATTGACCTGTTTCCTTGTGC AACAAGGTGGGACGCCAGAAAAGCAGAGGGGAAACAAGCATTGATCAAGATGAGTGTC TTAAATGGCTTGATTCTAAAGAAGAAGTTCGGTTCTATATGTTTGCCTTGGAAGTATCTGCAG TCTTCCTCTGTCTCAGCTCAAGGAGCTGGGGCTTAGGCCTTGAGGAATCCCAAAGACCTTTCATT TGGGTCGTAAGAGGTTGGGAGAAGACAAAGAGTTACTTGAGTGGTTCTCGGAGGCGGATTTG AAGAAAGAGATCAAAGACAGGCTTCCATCAAAGGATGGTCACCTCAAATGCTTATCCTTGC ACATCATTCCGTTGGAGGGTTCTTAACACACTGTCGAGGAACCTCGACCCTCGAAGGAATCACT TCAGGCGTTCCATTGCTCACTTGGCCACTGTTTGGAGACCAATTCTGAACCAAAACTTGTCG TGCCAGGTGCTAAAGTGGGTGATAAGTGCCCGGGTTGAAGAGGTTACGAATTGGGAGAAGAGGA GAAAATAGGAGTATTAGTGATAAGAAGAGTGAAGAGGCAGTGGAAGAATTAATGGGTGAG AGTGATGATGCTAAAGAATATTAAGAAAAAGAGTCAAGAGCTTGACAATTAGCTCACAAGGCTG TGGAGGAAGGAGGCTCATCTCATTCTAATATCACATCCTTGCTAGAAGACATAATGCAACTAGC ACAACCTAATAATTGA | 1057 | AFN26666 (Augustin et al., 2012) |
| Glycosylating enzyme (protein) [Barbarea vulgaris] | MVSEITHKSYPLHFVLFPFMAQGHMIPMVDIARLLAQRGVKITIVTTPHNAARFENVLSRAIES GLPISIVQVKLPSQEAGLPEGNETFDSLVSTKLLVPFFKAVNMLEEPVQKLFEEMSPQPSCIIS DFCLPYTSKIAKKFNIPKILLFHGMCCFCLLCMHVLRKNREILENLKSDKEHFVVPYFPDRVEFT RPQVPLATVVPGEWHEIKEDMVEADKISYGVIVNTYQELEPAYANGYKEARSGKAWTIGPVSLC NKVGADKAERGNKADIDQDECLKWLDSKEEGSVLYVCLGSICSLPLSQLKELGLGLEESQRPFI WVRGWEKNKELLEWFSESGFEERVKDRGLLIKGWSPQMLILAHHSVGGFLTHCGWNSTLEGIT SGVPLLTWPLFGDQFCNQKLVVQVLKVGVSAGVEVTNWGEEEKIGVLVDKEGVKKAVEELMGE SDDAKEIRKRVKELGQLAHKAVEEGGSSHSNITSLLEDIMQLAQPNN | 1057 | |
| Glycosylating enzyme (coding DNA) [Barbarea vulgaris] | ATGGCTTCTGAAACTACACATTCCATTCACCATTACATTTCGTTTTGTTCCCTTTTATGG CACAAGGTCATATGATCCCAATGGTTGATATCGCTAGAATCTTGGCACAAAGAGGTGTTACTAT CACAATCGTTACTACCACCACATAACGCTGCAAGATTCAAATCGTTGTCTAGAGCTATCCAA TCAGGTTTGCCAATTAATTTGGTTCAAGCAAAGTTCCCATCTCAGAGAATCTGGTTCATTGGAAG GTCATGAAAATTTGGATTCGTTGGAATTCTTTAGGTGCTTCATTGACTTTCTTAAGCAACAAA CATGTTCGAAAAGCCAGTTGAAAAGTTGTTAAAGAAATTCAACCAAGACCATGTATTATT GGTGACATGTGTTTTGCCATACTAACAGAATTGCTAAAGATATTCCAAAAATTATTT TTCATGGCATGTGTTGTTTTTAATTTGTTATGTATCATATATGAGACAAAACTACGAATTCTT GGAAACAATCGATTCTGAAAAGGAATACTTCCCAATCCCAAACTTCCCAGAAGAGCTGAATTC ACTAAGTCACAATTGCCAATGACATCATACGGTGTAGAATCGTGATTCAAAGAAATTCTTGGATGAAGTTA CTGAGAGATTGACAACAAACATCTTACGGTGTTATTGTTAACACTTTCAAGCTGCAATCGATCAAGATGAATGTA AATAAGGTTGGTGAATTCTAAGGAGAAGAAGCTAATAAGCTGAAAGAGGTTAATAAAGCTGCAATCGATCAAGATGAATGTA TCAAGTGGTTGGAATTTCACATTGGATTCTTAGGTGCTTCATTTCTTTCAAGAATCTCAAAGACCTTTTATT TGGGTTATTAGAGGTTGGGAAAAGTTGGAAAGTCAACCAAATAGCTGAATGGATCTCAATCAGTTTTA AAGAAAGAATTAAAGAAGAGTTTGTTGTTCAATTAGTTGGTGGTTGGTCTCCAATGGATTCTACTTTGAAGGATTACA ACATCCAGCAGTTGGTGGTTTCTTGACATGGCCATTATTTGTGACCAATTTATTGTCTTGAAGGATTACA TTCAGTGTTTCAATTTGTTAGATCTGGTGTTAGAAGAAGTTGATAAAGAAGGTGTTAAGAAAGCTGTTGAAGAAGA AAACATCGGTTGTTTTGGTTGATAAAGAAGGTGTTAAGAAGCTGTTGAAGAAGTTATGGGTGAA | 1058 | |

TABLE 1-continued

Some protein and DNA sequences disclosed herein

| Protein/DNA Description | Protein/DNA Sequence | SEQ ID NO | Accessio No./Reference |
|---|---|---|---|
| Glycosylating enzyme (protein) [Barbarea vulgaris] | TCTGATGATGCAAAGGAAAGAAGAAGAAGAGAGTTAAGGAATTAGGTCAATTGGCTCATAAAGCAG TTGAAGAAGGTGGTTCTTCACATTCTAACATCACATCATTGTTGCAAGATATTAGACAATTGCA ATCTAAGAAATAA | 1059 | AVW82175 (Erthmann et al., Plant Molecular Biology (2018) 97: 37-55, "Erthmann et al., 2018") |
| Glycosylating enzyme (protein) [Barbarea vulgaris] | MASETTHQFHSPLHFVLFPFMAQGHMIPWDIARLLAQRGVTITIVTTPHNAARFKNVLSRAIQ SGLPINLVQAKFPSQESGSLEGHENLDLLDSLGASLTFFKATNMFEKPVEKLLKEIQPRPSCII GDMCLPYTNRIAKNLGIPKIIFHGMCCFNLLCMHIMRQNYEFLETIDSEKEYFPINPFPERAEF TKSQLPMITYAGEFKEFLDEVTEGDNTSYGVIVNTFEELEPAYVRDYKKVKAGKVWSIGPVSLC NKVGEDKAERGNKAAIDQECIKWLDSKEEGSVLYVCLGSICNLPLSQLKELGLGLEESQRPFI WVIRGWEKTNELAEWISESGFKERIKERGLLIRGWSPQMLILSHPAVGGFLTHCGWNSTLEGIT SGVPLLTWPLFGDQFCNEKLVVQVLKVGVRSGVEESMKWGQEENLGVLVDKEGVKKAVEVMGE SDDAKERRRRVKELGQLAHKAVEEGGSSHSNITSLLQDIRQLQSKK | 1060 | |
| Glycosylating enzyme (coding DNA) [Barbarea vulgaris] | ATGGCATCTGAATCTGTCATCATTCTCATTGTCCATTGCATTTCGTTTTGTTCCCTTTATGG CTCAAGGTCATATAGTTCCAATGGTTGATATTGCTAGACTTCTAGAGTGTGCTACTAT CACAATCGTTACTACACCACATAACGAACTAGATTCAATAATTGTTGTCAAGAGCTATTGAA TCTGATTTGTCAATTAATATCGTTCATGTTAACTTCCCATACCAAGAAGCCAGGTTTGTCTGAAG GTCAAGAAACGTTGATTTGTTGGAATCAATGGGTTTGATGGTTCCATTTTTAAAGCTGTTAA CATGTTGGAAGAACCAGTTATGAAGTTGATGGAAGAAATGAAGCCAAGACCATCTTGTTGATT TCAGATTTTTGTTTACATTACACTTCTAGATCACTAAAAGTTTAATATCCAAAGATCGTTT TCCATGGTATGGGTTGTTTCTGTTTGTTGTATGCACGTTTAGAAGAACATCGAAATCTT GAAAAATTTTGAAGTCGATAAGGAATACTTTTGGTTCCATCATTCCCAGATATCGTTGAATTC ACTAAACCACAAGTTCCAGTTGAAGATACTTCATACGTGTTATTGTTAACACATTCCAAGATTGAAGAACCAGC TGGTTGAAGCTGAAGATACTTCATACGTGTTATTGTTAACACATTCCAAGATTGAAGAACCAGC TTACGTTAAGGATTCAAAGAAGCTAGAGCTGGTAAAGTTGGTCTATTGGTCCAGTTCATTG TGTAATAAGATCGAAGCTGATAAAGGACATAAGGAGGTAATAAGGCTGCAATCGATCAAGAAGAAT GTTGAAGTTGGTTGATTCTAAAAGAGAAGGTTCAGTTTGTCATGTTCCATTTTGTTGGGTTCTATCTG TAATTTGCCATTGGCTCAATTGAAGGTTGGAAAGTACAACAGAATTGTCTGAATGAGATTGGTGAATCAGGTT ATTTGGGTTATTAGAGGTTGGAAGAATAGAGGTTTGTTGGATAATAAGGTTGGTCTCCACAAATGTTGGTTTT ATCTCATTCCATCAGTTGGTGGTTTTCTTGCTCATCGTTGTTGGAATTCTACTTAGAAGGTATT ACATCAGGTGTTCCATTGTTAACATGGCCATTGTTTAACATGCCAGATCCAATTTGTAACCAAAAGTTGG TTGTTCAAGTTTTGAAAGTTGGTGTTAGAGCTGGTGATTAAGGAAGCCAGTTGAAGAATTAATGGGT AGAAAAAGTTGGTGTTTTGTTGAAGAAGAAGAAGAGTTAAGGAATTGGCTGAATTAGCTCATAAAG GAATCAGATGATGCTAAGGAAGAAGAAGAAGAGTTAAGGAATTGGCTGAATTAGCTCATAAAG CAGTTGAAGAAGGTGGTTCTTCACATTCTAACATTCTTGTTTTTACAAGATATTCTCAATA TAAATCAGTTGGTACATTTTAA | | |
| Glycosylating enzyme (protein) [Barbarea vulgaris] | MASESCHHSHCPLHFVLFPFMAQGHMIPWDIARLLALRGATTIIVTTPHNATRFNNLLSRAIE SDLSINIVHVNFPYQEAGLSEGQENVDLLESMGLMVPFLKAVNMLEEPVMKLMEEMKPRPSCLI SDFCLHYTSKITKKFNIPKIVFHGMGCFCLLCMHVLRRNIEILKNLKSDKEYFLVPSPDIVEF TKPQVPVETNASGDMKEFLEAMVEAEDTSYGVIVNTFQELEPAYVKDYKEARAGKVWSIGPVSL CNKIEADKAERGNKAAIDQEECLKWLDSKEEGSVLYVCLGSICNLPLAQLKELGIGLEESQRPF IWVIRGWEKTNELSEWMLESGFEERVKDRGLLIKGWSPQMLVLSHPSVGGFLTHCGWNSTLEGI TSGVPLLTWPLFADQFCNEKLVVQVLKVGVRAGVEDPMSWGEEEKVGVLLDKEGVKKAVEELMG ESDDAKERRRVKELGELAHKAVEEGGSSHSNITLFLQDISQYKSVGTF | 1061 | AVW82178 (Erthmann et al., 2018) |

TABLE 1-continued

Some protein and DNA sequences disclosed herein

| Protein/DNA Description | Protein/DNA Sequence | SEQ ID NO | Accessio No./Reference |
|---|---|---|---|
| Glycosylating enzyme (coding DNA) [Barbarea vulgaris] | ATGGCATCAATCAATCACTAACCATAAGTCTGATCCATTCGTTCTGTTTGTTCCCTTTATGGCTC<br>AAGGTCATATGATTCCAATGGTTGATATTGCTAGATTGTTAGCACAAAGAGGTTTGACTATCAC<br>AATCGTTACTACACCACATAATATCTTGCATGTTAAGTTGCCATATCAAGAAGTCGTTTACCTGAAGGTT<br>GGTTTGCCAATTAATAATCTTGCATGTTAAGTTGCCATATCAAGAAGTCGTTTACCTGAAGGTT<br>TGGAAAACATCGATTGTTTCGATTCAATGGAACATATGATCCCATTTTTCAAGGTGTTAACAT<br>GGTTGAAGAATCTGTTCCATACATCAAAGTTGTTCGAAGAAATGTCTCCAAGACCATCATGTATCATCTCT<br>GATTTCTGTTTGCCATACATCAAAGTTGTTCTAAAAGTTAATATCCAAAGATCTTGTTC<br>ATGGCATGTCGCTTATGTTTGTTGTGATGCATGTTTGTGTATGCCATACTTCCCAGATAAGATCGAATTGGA<br>AAATTGAAGTCTGATAAGGAACATTTCGTTCGTTCCATACTTCCCAGATAAGATCGAATTAACT<br>AGACCAAGTTCCAATGGATACATACGTTCGTGAATAAGGAATTCATGGAAGATTTGG<br>TTGAAGCTGATAAGACTTCTACGGTGTTATTGTTAACACATTTCAAGATTGGAACCAGCATA<br>CGTTAAGGATTACAAGGAAATCAGATCTGTAAAGCTTGGTCTGTTGGTCCAGTTGCTTTGTGT<br>AATAAGGCAAGAATCGATAAGGCTGAAAAGGAAGATCTGTTTTGTACGTTTGTTTGGGTTCAATCGTAA<br>TTTGCCATTGGCTCAATTGAAGAATGGGTTTAGGTTTGGAAGAATCTACAAGACCTTTTATT<br>TGGGTTATTAGAGGTTGGGATAAGATAGAGGTTTGTTGATTAAAGGTTGGTCACCACAAATGTTGATCTGTC<br>AAGAAGAATTAAGATAGAGGTTTGTTGATTAAAGGTTGGTCACCACAAATGTTGATCTGTC<br>TCATCAATCAGTTGGTGGTTTCTTGGACTCATTGTGGTTGGAATTCTACTTTAGAGGTATTACA<br>GCAGTTTGCCATTGTTAACATGGCCATTGTTCCGTGATCAATTCTGTAACGAAAAGTAGTTG<br>TTCAAGTTTTGAATTCAGGTGTTAGAGCAGGTGTTGAACAACCAATGAAAGCTGTGAAGAATTAATGGGTGAA<br>AAAGATTGGTGTTTTGGTTGATAAAGAAGAAGGTGTTAAGAAGGTGTAAGGAATTGGCTCATAAAGCAG<br>TCTGATGAAGCAAACGAAGAAGAAGAAGAAGCAAACAAATAAGAAGAAGGTGTTGCAAGATCATGAATTAGCC<br>TTGAAGAAGGTGGTCTTCCACATTCAAACATCACCATTTTTCTTGCAGATATCATGCAATTAGC<br>TCAATCTAATAATTAA | 1062 | |
| Glycosylating enzyme (protein) [Barbarea vulgaris] | MASINHKSDPLHFVLFPMAQGHMIPMVDIARLLAQRGLTITIVTTPHNASRFKNVLNRAIES<br>GLPINILHVKLPYQEVGLPEGLENIDCFDSMEHMIPFFKGVNMVEESVQKLFEEMSPRPSCIIS<br>DFCLPYTSKVAKKFNIPKIIFHGMCCLCLLCMHVLRKNPKILENLKSDKEHFVVPYFPDKIELT<br>RPQVPMDTYVPGELKEFMEDLVEADKTSYGVIVNTFQELEPAYVKDYKETRSGKAWSVGPVALC<br>NKARIDKAERGNKSDIDQDECLKWLDSKEERSVLYVCLGSICNLPLAQLKELGLGLEESTRPFI<br>WVIRGWDKNKQLVEWFSESGFEERIKDRGLLIKGWSPQMLILSHQSVGGFLTHCGWNSTLEGIT<br>AGLPLLTWPLFADQPCNEKLVVQVLNSGVRAGVEQPMKWGEEEKIGVLVDKEGVKKAVELMGE<br>SDEANERRRRAKELGELAHKAVEEGGSSHSNITFLLQDIMQLAQSNN | 1063 | AVW82181 (Erthmann et al., 2018); with a truncation at C-terminus as compared to SEQ ID NO: 1067 |
| Glycosylating enzyme (coding DNA) [Barbarea vulgaris] | ATGGCTTCTGCAAATTGCATCAATTCCATCCATCACATTCGTTTTGTTCCCTTTATGG<br>CTCAAGGTCATATGATCCCAATGACATCGATAATCGCTAGATTGTTGGCACAAAGAGGTGTTACTAT<br>CACAATCGTTACTACATTGCATAATCTCTGCTAGATTCAGAAACGTTTGTCTAGACAATCGAA<br>TCAGGTTTGCCAATTAATTGGTTCATGTTAAGTTCCCATATCAAGAAGCTGGTTTACCAGAAG<br>GTCAAGAAAACATCGATTCTTTGGATTCAAAGAGTTAACTGTTCCATTTTCAAGGCAGTTAA<br>CATGTTGGAAGAACCAGTTATGAAGTTGATGGAAGAAATGCTAAAGTTTTAATATCCAAAGATCGTTT<br>TCAGATTGTTGTTTGCCATATACATTCTAAAATTGCTAAAAGTTTAAGAAGAAATTGGAAATTTT<br>GCAAAATTTGAAGTCAGATAAGAATACTTCTGATCCCAAACTTCCCAGATAGAGTTGAATTC<br>ACTAAACCACAAGTTCCAGTTAGAATTAAGTCTTCTGGTGACTGGAAAGTTTCTTGGATGAAA<br>TGGTTAAAGCAGAAGAAACTTCATATGGTGTTATTGTTAACACATTCCAAGAATTAGAACCAGC<br>ATACGTTAAAGATTTCAAGAAGCTAGAGCTGGTAAAGTTGGTCTATTGGTCCAGTTTCATTG<br>TGTAATAAGATCGAAGCTGATAAGGCTGATAAGAAGTAATAACGTCAATCGATCAAGATGAAT<br>GTTTGAAGTGTTGATTCTAAAGAGGTTGATTCAGTTGTTGTACGTTTGTTTGGGTTCTATCTG | 1064 | |

TABLE 1-continued

Some protein and DNA sequences disclosed herein

| Protein/DNA Description | Protein/DNA Sequence | SEQ ID NO | Accessio No./Reference |
|---|---|---|---|
| Glycosylating enzyme (protein) [Barbarea vulgaris] | TAATTTGCCATTGGTTCAATTGATTGAATTGGGTTTAGGTTTGAAGAATCTCAAAGACCTTTT ATTTGGGTTATTAGAGGTTGGGAAAAGTACAACGAATTATCAGAATGAATCTCTGAATCAGGTT TCGAAGAAAGAGTTAAGGATAGAGTTTGTGATCAGAGGTTGGGCTCCACAAGTTTAATTTT GTCTCATCCATCAGTTGGTTGTTTCTTGACTCATTGTTGGTGAATTCTACTTTAGAAGGTATT ACATCAGGTGTTCCATTGTTAACATTACCATTGTTTGGTGACCAATTTGTAACCAAAGTTGA TCGTTCAAGTTTTGAAAGTTGGTGTTTCTGCTGGTGTTGAAGAAGTTATGGGTTGGGTGAAGA AGAAAAGATTGGTGTTTTGTGTTGTAAGGAAGAAGTTAAGAAACTGTCGAAGAAGTTATGGGT GAATCAGATGATGCAAGGAAAGAAGAAGAAGAGTTAAGGAATTGGGTAAATTGGCTCATAAAG CAGTTGAAGAAGGTGGTTCTTCCACATTCTAACATCACATTATTTTGCAAGATATGTGTCAAT ACAATCAGTTGGTATCTATTAA | 1065 | AVW82184 (Erthmann et al., 2018) |
| Glycosylating enzyme (protein) [Barbarea vulgaris] | MASAKLHQFHPSLHFVLFPPMAQGHMIPMIDIARLLAQRGVTITIVTTLHNSARPRNVLSRAIE SGLPINLVHVKFPYQEAGLPEGQENIDSLDSKELTVPFFKAVNMLEEPVMKLMEEMKPRPSCLI SDLCLPYTSKIAKKFNIPKIVFHGMGCFCLLCMHVLRRNLEILQNLKSDKEYFWIPNFPDRVEF TKPQVPVRINASGDWKVFLDEMVKAEETSYGVIVNTFQELEPAVVKDFQEARAGKVWSIGPVSL CNKIEADKAEBRGNKAAIDQDECLKWLDSKEGGSVLYVCLGSICNLPLVQLIELGLGLEESQRPF IWVIRGWEKYNELSEWISESGFEERVKDRGLLIRGWAPQVLIISHPSVGGFLTHCGWNSTLEGI TSGVPLLTLPLFGDQFCNQKLIVQVLKVGVSAGVBEVMGWGEEEKIGVLVDKERVKKTVEEVMG ESDDAKERRRVKELGKLAHKAVEEGGSSHSNITLFLQDMCQLQSVGIY | 1066 | |
| Glycosylating enzyme (coding DNA) [Barbarea vulgaris] | ATGGCATCAATAACTAACCATAAGTCTGATCCATTCGATTTCGTTTTGTTCCCTTTTATGGCTC AAGGTCATATGATTCCAATGATTGATATTGCTAGATTGTTAGCACAAAGAGGTTGACTATCAC AATCGTTACTACACCACCATAACGCATCAAGATTCAAAACGTTTTCAATAGAGCTATTGAATCT GGTTTGCCAATTAATCTTGCATGTTAAGTTGCCATATCAAGAGAGTCCGTTTACTGAAGGTT TGGAAAACATCGATTCGTTCGATTCAATGGAACATATGAATGTCTCCAAGACCATCATATCATCT GATTTCTGTTTGCCATACACCATCAAAGGTTGCTAAAAGGTTTAATATCCCAAAGATCTTGTTC ATGGCATGTCTGCTTATGTTTGTTGTATGCATGTTTGAGAAGAAGATCCAAAGATCTTGGA AAATTTGAAGTCTGATAAGGAACATTTCGTTCGTTCCATACTTCCCAGATAAGAATCGAATTAACT AGACCACAAGTTCCAATGGATACATACGTTCCTCGTGAATTAAGAAGCATTTCAAGAATTGG CGTTAAGGATTACAAGGAAACTAGATCTGTGTTATTGTTAACACATTTCAAGAATTGGACCAGCATA AATAAGGCAAGAATCGATAAGGCTGAAAGAGGTAATAAGTCTGATATCGATCAAGATGAATGTT TGAAGTGGTTGGATTCAAAGAGGAAGAGAATCTGTTTTGTACGTTTGTTTGGTTCAATCGTAA TTTGCCATTGGCTCAATTGGAGAAGATAGAGGTTAGGTTTGAAGAATCTACAAGACCTTTTATT TGGGTTATTAGAGGTTGGGATAAGATAAGCAACTTGGTTGAATGGTTCTCTGAATCAGGTTTCG AAGAAAGAATTAAAGATAGAGGTTTCTTGACTCAGTGGTTCTTGATTAAAGGTTGCTCACCCAA AATGTTGATCTGTC TCATCAATCAGTTGGTGGTTCCTACATGGCCATTGTTCGCTGATCAATTCTACTTAGAAGGTATTACA GCAGTTTGCCATTGCCATACATGGCCATTGTTCGCTGATCAATTCTACTTAGAAGGTATTACA TTCAAGTTTGAATTCTGGTTTAGACAGGTGTTAGACAGGTTGAACAACCAATGAAATGGGGTGAAGAAGA AAAGATTGGTGTTTTTGGTTGATAAAGAAGGTGTTAAGAAACGTGTTGAAGAATTAATGGGTGAA TCAGATGAAGCAAACGAAAGAAGAAGAAGAGCTTAAGACTCATTTTGTTGCAAGATATCATGCAATTGGC ACACCAATCACAGACCATCATTTTGCTCATCACATTTTGCAAATCTTGGCATTACAAGAAAAGTTTGTAATT AATTTTGTTACAAAGAACTGGTTCATTACCATCTAAATAA | 1066 | |
| Glycosylating enzyme [Barbarea vulgaris] | MASITNHKSDPLHFVLFPPMAQGHMIPMAQGHMIPMVDIARLLAQRGLTITIVTTPHNASRFKNVLNRAIES GLPINLHVLKLPYQEVGLPEGLENIDCDSMEHVMIPFFKGVNMVEESVQKLFEEMSPRPSCIIS DFCLPYTSKVAKKFNILFHGMCCLLCLLCMHVLRKNPKILENIKSDKEHFVVYPFPDKIELT | 1067 | AVW82181 (Erthmann et al., 2018) |

TABLE 1-continued

Some protein and DNA sequences disclosed herein

| Protein/DNA Description | Protein/DNA Sequence | SEQ ID NO | Accessio No./Reference |
|---|---|---|---|
| | RPQVPMDTYVPGELKEFMEDLVEADKTSYGVIVNTFQELEPAYVKDYKETRSGKAWSVGPVALC NKARIDKAERGNKSDIDQDECLKMLDSKEERSVLYVCLGSICNLPLAQLKELGLGLEESTRPFI WVIRGMDKNKQLVEWFSESGFEERIKDRGLLIKGWSPQMILSHQSVGGFLTHCGWNSTLEGIT AGLPLLTWPLFADQPCNEKLVVQVLNSGVRAGVEQPMKWGEEEKIGVLVDKEGVKKAVEELMGE SDEANERRRAKELGELAHKAVEEGGSSHSNITFLLQDIMQLAQPITEPSFLVQSWHYKKALLI NLLQRTGHYQSK | | |
| Glycosylating enzyme (coding DNA) [Barbarea vulgaris] | ATGGTTTCTGAAATCACTCATAAGTCATACCCATTGCATTTTGTTTTGTTCCTTTTATGGCTC AAGGTTCATATGATTCCAATGGTTGATATTGCTAGATTGTTGGCACAAAGAGGTGTTAAGATCAC AATCGTTACTACACCAATCATAACGCTGCAAGATTCAAAACGTTTGTCAAGAGCTATTGAATCT GGTTTGCCAATCTCAATCGTTCAGTGTTAAGTTGCCATCTCAAGAGACGAGTTTGCCAGAGGTA ACGAAACTTTGGATTCTTTGGTTCAATGGAATTAATGATCCATTTCTTGAAGCTGTTAACAT GTTGGAAGAACCAGTTCAAAAGTTGTTCGAAGAAATGTCTCCACAACCATCATGTATTATTCT GATTTTTGTTTACCATACACAGTTCAAAAGTTGTTCGAAGAAATGTCTCCACAACCATCATGTATTATTCT ATGGCATGTGTGTTTCTGTTTGTGTATGCATATCTTAAGAAGAATAGAGAAATTGTTGA AAATTTGAAATCAGATAAGGAACATTTCGTTGTTCCATACTTCCAGATAGAGTTGAATTCACT AGACCACAAGTTCCAGTTGCTACATACGTTCCTGGTGACTGGCATGAATTACTGAAGATATGG TGCAAATGATTACAAAGAAGCTAGATCTGTTAAGCATGACAATTGGTCCAGTTTCATTGTGT AATAAGGTTGGTGCTGAACTCAAGGAGAAGAAGGTTCAGTTTGTTTGGGTTTCTATCTGTAA TTTGCCATTGTCACATTGGTCAGGTTGGGAAAAGAATAAGGAAATTGCATGAATCGTTCTCAAGACCTTTATT TGGGTTATTAGAGGTTGGGAAAAGAATAAGGAAATTGCATGAATCGTTCTCAAGACCTTTCG AAGAAGAATTAAAGATAAGAGTTGTTGATTCATTGGGTCTTGGAATTCAACTTTAGAAGGTGCTCCCACAAATGTTGATCTGTC TCATCATTCAGTTGGTGTTGTTCTTGACTCAGTTGCCTTGGAATTCAACTTTAGAAGGTTTGACA GCAGTTTACCATTGTTAACATGGCCATTGTTCCGCTGACCAATTCTGTAACGAAAAGTTGGCAG TTCAAGTTTTGAAAGCTGGTTTTCTCGCAGGTGTTGATCAACCAATGAAATGGGTGAAGAAGA AAAGATTGGTGTTTTGGTTGATAAGGAAGGTGTTAAGAAAGCTGTTGAAGAATTGATGGGTGAA TCAGATGATCGTAAGGAAATCAGAAGAGCAAAGAATTAGGCGCGAATTGGCTCATAAAGCAG TTGAAGAAGGTGGTTCTTCACATTCAAACATCACTTCTTTGTTGAAGATATCATGCAATTGGC ACAATCTAATAATTAA | 1068 | |
| Glycosylating enzyme [Barbarea vulgaris] | MVSEITHKSYPLHFVLFPFMAQGHMIPMVDIARLLAQRGVKITIVTTPHNAARFKNVLSRAIES GLPISIVQVKLPSQEAGLPEGNETLDSLVSMELMIHFLKAVNMLEEPVQKLFEEMSPQPSCIIS DFCLPYTSKIAKKFNIPKIIFHGMCCFCLLCMHIILRKNREIVENLKSDKEHFVVPYFPDRVEFT RPQVPVATVVPGDWHEITEDMVEADKTSYGVIVNTYQELEPAYANDYKEARSGKAWTIGPVSLC NKVGADKAERGNKADIDQDECLKWLNSKERGSVLYVCLGSICNLPLSQLKELGLGLEESQRPFI WVIRGWEKNKELHEWFSESGFEERIKDRGLLIKGWAPQMLILSHHSVGGFLTHCGWNSTLEGLT AGLPLLTWPLFADQPCNEKIAVQVLKAGVSAGVDQPMKWGEEEKIGVLVDKEGVKKAVEELMGE SDDAKEIRRRAKELGELAHKAVEEGGSSHSNITSLLEDIMQLAQSNN | 1069 | AFN26668 (Erthmann et al., 2018) |
| Glycosylating enzyme (coding DNA) [Barbarea vulgaris] | ATGGTTTCAGAAATCACTCACTAAGTCTTACCCATTGCATTTTGTTTTGTTCCTTTTATGGCTC AAGGTCATATGATTCCAATGGTTGATATTGCTAGATTGTTGGCACAAAGAGGTGTTAAGATCAC AATCGTTACTACACCAATATGCTGCAAGATTCAAACGTTTGTCAAGAGCTATTGAATCA GGTTTGCCAATCTCATCGTTCAGTTAAGTTGCCATCACAAGAGCAGTTTGCCAGAGGTA ACGAAACTTTGGATTCTTTAGTTTCAATGGAATTGTTGTTCCATTTTCAAGTCGTGTTAACAT GTTGGAAGAACCAGTTCAAAAGTTGTTCGAAGAAATGTCTCCACAACCATCATGTATTATTCT GATTTTTGTTTACCATACACATCAAAATTGTTCTAAAGTTTAATATCCAAAGATCTTGTTCC ATGGCATGTGTGTTTCTGTTTGTGTATGCATGTTTTGAGAGAATCATGAAATCGTTGA | 1070 | |

TABLE 1-continued

Some protein and DNA sequences disclosed herein

| Protein/DNA Description | Protein/DNA Sequence | SEQ ID NO | Accessio No./Reference |
|---|---|---|---|
| | AAATTTGAAATCTGATAAGGAACATTTCGTTCTTGTTCCATACTTCCCAGATAGAGTTGAATTCACT<br>AGACCACAGTTCCAGTTGCTACATACGTTCCTGGTGACTGGCATGGCAGAAATTACTGGTGACATGG<br>TTGAGCAGATAAGACTTCTACGGTGTTATTGTTAACACATGTCAAGAATTAGAACCAGCTTA<br>TGCAAATGATTAACAAGAAGCTAGATCTGGTAAAGCATGGACAATTGGTCCCAGTTCTTTTGTGT<br>AATAAGGTTGGTGCTGATAAGCAGAAAGGAAGAAGGTTCTGTTTTGTACGTTTGGGTTCAATCTGTAA<br>TGAAGTGGTTGAACTCAAAGGAGAAGAAGGTTCTGTTTTGGGTTGTAATCACAAGACCTTTATT<br>TTTGCCATTGCTCTCAATTGAAGGAGTTGGGTTTGGGTTTGAAGAATCACAAAGACCTTTATT<br>TGGGTTATTAGAGGTTGGGAAAAGATAGAGGAATTGTTGATGAAGGTTGGCTCCTGAATCAGGTTTCG<br>AAGAAAGAATTAAAGATAAGAGGTTGTTGATTAAAGGTTGGCTCCACAAATGTTGATCTTGTC<br>TCATCATTCAGTTGGTGGTTTCTTGACTCATCTGTGGTTGGAATTCTACTTTAGAAGGTTTGACA<br>GCAGTTTTACCATTGTTAACATGCCATTGTTGCTGATCAATTCTGTAACGAAAAGTTGGCAG<br>TTCAAGTTTTGAAAGCTGGTGTTTCAGCAGGTGTTTGATCAACCAATGAAAATGGGGTGAAGAAGA<br>AAAGATTGGTGTTTTGGTTGATAAGGAAGGTGTTAAGAAAGCTGTTGAAGAATTGGCTCATAAGCAG<br>TCTGATGATGCTAAGGAAATCAGAAGAAGCAAAGGAATTAGCCGAATTGGCGAATTCATGCAATTGGC<br>TTGAAGAAGGTGGTTCTTCACATTCAAACATCACTTCTTTGTTGGAAGATATCATGCAATTGGC<br>ACAATCTAATAATTAA | | |
| Glycosylating<br>enzyme [Barbarea<br>vulgaris] | MVSEITHKSYPLHFVLFPPMAQGHMIPMVDIARLLAQRGVKITIVTTPHNAARPENVLNRAIES<br>GLPISIVQVKLPSQEAGLPEGNETFDSLVSMELLVPFFKSVNMLEEPVQKLFEEMSPQPSCIIS<br>DFCLPYTSKIAKKFNIPKILFHGMCFCLLCMHVLRKNHEIVENLKSDKEHFVVPYFPDRVEFT<br>RPQVPVATVPGDWHEITGDMVEADKTSYGVIVNTCQELEPAYANDYKEARSGKAWTIGPVSLC<br>NKVGADKAERGNKADIDQDECLKWLNSKEEGSVLYVCLGSICNLPLSQLKELGLGLEESQRPFI<br>WVIRGWEKNKELLEWFSESGFEERIKDRGLLIKGWAPQMLILSHHSVGGFLTHCGWNSTLEGLT<br>AGLPLLTWPLFADQFCNEKLAVQVLKAGVSAGVDQPMKNGEEEKIGVLVDKEGVKKAVELMGE<br>SDDAKEIRRRAKELGELAHKAVEEGGSSHSNITSLLEDIMQLAQSNN | 1071 | AFN26669<br>(Erthmann et<br>al., 2018) |
| EPH coding DNA<br>[Cucumis melo] | ATGGATGCCATTCAACATACTACCATCAAAACGAATGCATAAAATGCATATTGCGAGTGTAG<br>GGAATGGACCTGTCGTTCTTCTTACAGGTTTCCCGAATTGTGGTATTCTTGGAGACATCA<br>ACTCCTTTATCTGAGTTCAGTGGGATATCCGCCAATAGCTCCAGATTTCAGAGGATACCGTGAT<br>ACCGATTCTCCAGAAAGCCATACTCTTATACAGCCTTACACATTGTTGAGATCTAGTAGGTG<br>CTTTAGACGAGTTAGGCATTGAAAAGGTCTTCTTGGTTGGGCATGATTGGGGTGCCATAATAGC<br>CTGGTATTTCTGCCTATTTAGACCAGAGAGATCAAAGCATTGGTCAACCTTTCAGTCCAATTC<br>TTTCCACGTAATCCGCTATCTCGTTCATTCAGCCATTTAGAGCTGCATATGGGATGATTTCT<br>ACATGTAGGTTCCAAGTTCCAGAGAAGCTGAAGCACAGATTTTGCCTGTATTGACACAGCACA<br>ACTGTTCAAAACTACCCTATCTAACAGATCCAGAAAGCTCCGTGTTGCCTAAAGAATACGGT<br>TTTAGGCTATTCCACCACTCAGAATTGCCTTCATCATGGCTAACTGAAGAAGACATAACTACT<br>ATGCAGCGAAGTTTAAGGAACTGGTTTTACAGGTGTTCAGATTCAAGTGCCTGTTAAGTTCATAGTA<br>TACTTGGGAACTGACTGCTCCTTGACACAGGTGTTCAGATTCAAGTGCCTGTTAAGTTCATAGTA<br>GGTGATTCCCGACTTAACATACCATTTTAAGGGTGCAAAGGAGTACATTCATGAAGGTGGCTTTA<br>AAAGAGACGTACCCTTATTGGAAGGATTGTTATCGTGGAAAATGCCGGTTCATTTTGTTCACGA<br>AGAAAAACCCCATGAGATAAATACACACATTCACGACTTCATCAAGAAATTTAA | 1072 | |
| EPH protein<br>[Cucumis melo] | MDAIQHTTIKTNGIKMHIASVGNGPVLLLHGFPELWYSWRHQLLYLSSVGYRAIAPDLRGYGD<br>TDSPESHTSYTALHIVGDLVGALDELGIEKVFLVGHDWGAIIAWYFCLFRPERIKALVNLSVQF<br>FPRNPAISFIQRFRAAYGDDFYMCRFQVPGEAEADFACIDTAQLFKTTLSNRSTKAPCLPKEYG<br>FRAIPPPENLPSWLTEEDINYYAAKFKETGFTGALNYYRAFDLITWELTAPWTGVQIQVPVKFIV<br>GDSDLITYHFKGAKEYIHEGGFKRDVPLLEEVVIVENAGHFVHEEKPHEINTHIHDFIKKF | 1073 | XP_008454322 |

TABLE 1-continued

Some protein and DNA sequences disclosed herein

| Protein/DNA Description | Protein/DNA Sequence | SEQ ID NO | Accessio No./Reference |
|---|---|---|---|
| MtUGT73K1 protein [Medicago truncatula] | MGTESKPLKIYMLPFFAQGHLIPLVNLARLVASKNQHVTIITTPSNAQLFDKTIEEKAAGHHI RVHIIKFPSAQLGLPTGVENLFAASDNQTAGKIHMAAHFVKADIEEFMKENPDVFISDIIFTW SESTAKNLQIPRLVENPISIFDVCMIQAIQSHPESFVSDSGPYQIHGLPHPLTLPIKPSPFAR LTESLIEAENDSHGVIVNSFAELDEGYTEYENLTGRKVWHVGPTSLMVEIPKKKVVSTENDS SITKHQSLTWLDTKEPSSVLYISFGSLCRLSNEQLKEMANGIEASKHQFLMVVHGKEGEDENW LPKGFVERMKEEKKGMLIKGWVPQALILDHPSIGGFLTHCGWNATVEAISSGVPMVTMPGFGDQ YYNEKLVTEVHRIGVEVGAEWSMSPYDAKKTVVRAERIEKAVKLMDSNGEGGEIRKRAKEMK EKAWKAVQEGGSSQMCLTKLVDYLHSVVTKSVELN | 1074 | AAW56091 |
| MtUGT73K1 coding DNA [Medicago truncatula] | ATGGGTACTGAATCTAAGCCATTGAAGATCTATATGTTGCCATTTTTCGCTCAAGGTCATTTGA TCCATTGGTAATTGGCTAGATTTGGCCAATCTAGCAATTGGACATCAACATGTTACTATCACTACT ACCATCAAACGCTCAATTGTTCGATAAGACAATCGAAGAAGAAAAAGCTGCAGGTCATCATATC AGAGTTCATATTATTAAGTTCCCATCTGCACAATCTGGTTACCAACTGGTGTTGAAAATTTGT TCGCTGCATCAGATAACCAAACAGCTGGTAAAATCCATATGGCTGCACATTTCGTTAAGGCAGA TATCGAAGAGAATTCATGAAGGAAAATCCACCAGATGTTTTATTTCTGATATCATTTTACTTGG TCTGAATCAACAGCTAAAAATTTGCAAATCCCAAGATTGGTTTTAATCAATCTCAATCTTTG ATGTTTGATGATTCAAGCAATTCATCATCCAGAATCATTTGTTTCTGATTCAGGTCCATA TCAAATTCATGGTTTGCCACCATCCATTGACTTTACCAATTTAAACCATCTCCAGGTTCGCTAGA TTGACAGAATCATTGATCGAAGCAGAAAACGATTCTCATGGTGTTATTGTTAACTCATTCGCTG AATTGGATGAAGGTTACACTGAAGTTGAAAATCCCAAAGAAGAAAATTTGACAGGTAGAAAAGTGTTTCTACTGAAAACGATTCT TCCAACTTCTTTGATGGTTGAAATCCAAAGAACATGAAAAGAACCATCTTCAGTTTTGTACA TCTCTTCGGTTCAATTGTGTAGAATTCGTCTAACGACAATCGAAGGAAAATGGCTAACGGTATCGA AGCATCAAAGCATCAATTCTTGTGGTTGTCATGGTGAAGATGAAGGCATGTTGAAGATAACTGG TTGCCAAAGGGTTCGTTGAAAAGAATGAAGGAAGAAAAGAAAAGCATGTTGATTGAAGGTTGGAA TGCTACAGTTGAAGCAATTCTTTCCAGGTCCAATGGTTACTATGCCAGGTTTCGGTGACCAA TACTACAACGAAAGTTGGTTACAGAAGTTCATAGAATTGGTGAAGGTCATCCAGGTCCAGGTCTGCAGAAT GGTCTATGTCACCATATGATGCTAAGAAAACGTTGTTAGAGCTGAAATCAGAAGAGAGCAAAGGCAGT TAAGAAATTGATGGATTCTAACGGTGAAGGTGGTGAAATCAGAAAGAGAGCAAAGGAAATGAAG GAAAAGCTTGCAAAGCAGTTCAAGAAGTGGTTCTTCACAAGCTGTTTGACTAAGTTGGTTG ATTACTTGCATTCTGTTGTTGTTACAAAGTCAGTTGAATTAAATTAA | 1075 | |
| MtUGT71G1 protein [Medicago truncatula] | MSMSDINKNSELIFIPAPGIGHLASALEFAKLLINHDKNLYITVFCIKFPGMPFADSYIKSVLA SQPQIQLIDLPEVEPPPQELLKSPEFYIILTFLESLIPHVKATIKTILSNKVVGLVLDFFCVSMI DVGNEFGIPSYLFLTSNVGFLSLMLSLKNRQYEVFDSDRDHQLLNIPGISNQYPSNVLPDAC FNKDGGYIAYYKLAERFRDTKGIIVNTFSDLEQSSIDALYHDHEKIPPIYAVGPLLDLKGQPNP KLDQAQHDLILKWLDEQPDKSVVFLCFGSMGVSFGPSQIREIALGLKHSGVRFLWSNSAEKKVF PEGFlEWMELEBGKGMICGWAPQVEVLAHKAIGGFVSHCGWNSILESMWFGVPIILTWPIYAEQQL NAFRLVKEWGVGLGLRVDYRKGSDVVAAEEIEKGLKDLMDKDSIVHKKVQEMKEMSRNAVVDGG SSLISVGKLIDDITGSN | 1076 | AAW56092 |
| MtUGT71G1 coding DNA [Medicago truncatula] | ATGTCTATGTCAGATATCAATAAGAACTCTGAATTAATTTTCATTCCAGCTCCAGGTATTGGTC ATTTGGCTTCAGCATTGAATTTGCAAAGTTGTTGACTAACCATGATAAGAATTTGTATATTAC AGTTTTCTGTATTAAATTCCTGGTATGCCATTCGATTTGCCAGAAGTTGAACCACCACCAAGAAATTGTTGA TCTCAACCACAACCAAATCCAATTGATCGATTTGCCACATTTTTGAAGCTTTAAGTCTCATAAGTCAGTTTGCA AGTCTCCAGAATTCTACATCTGACATTTGGACATTTTTGGACATTATTTTGATCCAGTTAAGGCTACTAT TAAAACAATCTTGTCTAATAAGGTTGTTGGTTTGGTTTTGGATTTCTTTTGTTTCAATGATC GATGTTGGTAACGAATTCGGTATCCCATCTTACTTGTTTTTTAACATCAAACGTTGTTTCTTGT | 1077 | |

TABLE 1-continued

Some protein and DNA sequences disclosed herein

| Protein/DNA Description | Protein/DNA Sequence | SEQ ID NO | Accessio No./Reference |
|---|---|---|---|
| PgUGT74AE2 protein [Panax ginseng] | CATTGATGTTGTCTTTGAAAAATAGACAAATGAAGAAGTTTCGATGATTCGATAGAGATCA TCAATTGTTGAACATCCCAGGTATCTCTAACCAAGTTCCATCAAACGTTTTGCCAGATGCTTGT TTCAATAAGGATGGTTGGTTACATCCTTACTACAGTTGCAGAGAAGATTCAGAGATACTAAGG GTATCATCGTTAACACATTTTCTGATTTGGAACAATCTTCAATCGATGCTTGTACGATCATGA TGAAAAGATTCCACCAATCTATGCAGTTGTCCATTGTTAGATTTGAAAGGTCAACCAAATCCA AATTGGATCAAGACACAACATGATTTGATCTTGAAGTGGTTGGATGAACAACCTGATAAGTCTG TTGTTTTCTTTGTTTCGGTTCAGTGTTAGATTTTTATGGTCTAACTCAGCAGAAAGAAATCGC TTTGGGTTTGAAGCATTCAGGTGTTAGATTTTTATGGTCTAACTCAGCAGAAAGAAAGTTTT CCAGAAGGTTTCTTGGAATGGATGAAAGCAATTGGAGGGTAAAGCATGATTTGTGGTTGGGCTCCAC AAGTTGAAGTTTTGCCTCATAAAGCAATTGGAGGGTAAAGCATGATTTGTGGTTGGAACTCTAT CTTGAATCAATGTGGTTCGGTGTTCCAATTTGCCTAATCTATGCTGACAACAATTG AACGCTTTTAGATTGGTTAAGGAATGGGGTGTTGGTTTGGGTTTGAAGGATTTGAATTACAGAAAAG GTTCTGATGTTGTGCTGCAGAAGAAAGTTCAAGAAATGAAGGAAATGTTCAAGAAAGTCTGTTGTTGATGGTGGT TATTGTTCATAAGAAAGTTCTGTTGGTAAATTGATCGATGATATCACCAGGTTCAAATTAA<br><br>MLSKTHIMFIPFPAQGHMSPMMQFAKRLAWKGVRITIVLPAQIRDSMQITNSLINTECISFDFD KDDGMPYSMQAYMGVVKLKVTNKLSDLLEKQKTNGYPVNLLVVDSLYPSRVEMCHQLGVKGAPF FTHSCAVGAIYYNAHLGKLKIPPEEGLISVSLPSIPLLGRDDLPIIRTGIFPDLFEHLGNQFSD LDKADMIFFNIFDKLENEEAKWLSSQWPITSIGPLIPSMVLDKQLPNDKGNGINLYKADVGSCI KWLDAKDPGSVVYASFGSVKHNFGDDYMDEVAWGLLHSKYNFIWVVIEPERTKLSSDPLAEAEE KGLIVSWCPQLEVLSHKSIGSFMTHCGWNSTVEALSLGVPMVAVPQQFDQPVNAKYIVDVWQIG VRVPIGEDGVVLRGEVANCIKDVMEGEIGDELRGNALKWKGLAVEAMEKGGSSDKNIDEFISKL VSS | 1078 | JX898529 |
| PgUGT74AE2 coding DNA [Panax ginseng] | ATGTTGTCAAAGACTCATATACTGATGTTCATCCCATTTCCAGCTCAAGGTCATATGTCTCCAATGA TGCAATTGCTAAAGATTAGCATGCAAGGGTGTTAGAATCACAAATCGTTTTGCCAGCACAAAT TAGAGATTCAATGCAAATCACTAACTCTTTGATTAATACAGAAATGTATTTCATTTGATTCGAT AAGGATGATGGTATGCCATACTCTATGCAAGCTTACATGGGTGTTGTTAAGTTGAAGTTACTA ATAAGTTGTCTGATTTGTTGGAAAGACAAAGACTAACGTTACCAGTTAATTTGTTGGTTGT TGATTCATTGTACCCATCTAGAGTTGAAATGTGTCAATCATTACAACCACATTGGGTAAAGTGCTCCATT TTCACTCATTCTTGTGTTGGTGCAATCTATTACAACGACCATTGGGTAAATTGAAGATTC CACCAGAAGAAGGTTTGACATCTGTTTCATTACCATCAATTCCATTGTTAGGTAGAGATGATTT GCCAATCATCAGAACTGGTACATTCCCAGATTTGTTCGAACATTTGGGATAACCAATTTTCTGAT TTGGATAAGGCTGATTGGATTTTCTTTAACACTTTCGATAAGTTGGAAAATGAAGAAGCAAAAT GGTTGCTTCCACAATGGCCAATTACAATCTAGCATGGTCCATTCATTATGATTGTGATAA GCAATTGCCAAACGATAAGGGTAACGGTATTAATTTGTACAAGCTGATGTTTGGTTCATGTATT AAATGGTTGGATGCTAAAGATCCAGGTTCTGTTGTTTACGCATCTTCGTTCAGTTAAGCATA ACTTCGGTGACGATTACATGGATGAAGTTGCATGGGGTTTGTTGCATTCAAAGTACAACTTCAT CTGGGTTGTTATTGAACCAGAAAGACTAAGTTGCTTCTTCAGATTTCTTCGGCTGAAGCAGAAGAA AAAGGTTTGATTGTTTCTTGGTGTCCACAATTGGAAGTTTGTCTCATAAGTCAATCGGTTCTT TTAATGACTCATTGTGGTTGGAATCAACAGTTGAAGCTTTGTCTTTTGAGGTACATCGTTCATGTTTGGCAAATTGGT AGTTCCACACAACAATTCGATCAACCAGTTAACGCTAAGTATATTGTTGATGTTTGGCAAATTGGT GTTAGAGTTCCAATTGGTGAAGATGGTGTTGTTTTGAGAGGTGAAGTTGCTAACTGTATCAAGG ATGTTATGGAAGGTGAAATTGGTGACGAATTGCGTGGTAATGCATTAAGAACATCGATGAATTCATTTCAAGG TGTTGAAGCAATGGAAAAAGGTGGTTCTTCAGATAAGAACATCGATGAATTCATTTCTAAATTG GTTTCTTCATAA | 1079 | |

TABLE 1-continued

Some protein and DNA sequences disclosed herein

| Protein/DNA Description | Protein/DNA Sequence | SEQ ID NO | Accessio No./Reference |
|---|---|---|---|
| PgUGT71A27 protein [Panax ginseng] | MKSELIFLPAPAIGHLVGMVEMAKLFISRHENLSVTVLIAKFYMDTGVDNYKSLLTNPTPRLT IVNLPETDPQNYMLKPRHAIFPSVIETQKTHVRDIISGMTQSESTRVVGLLADLLFINIMDIAN EFNVPTYVYSPAGAGHLGLAFHLQTLNDKKQDVTEFRNSDTELLVPSFANPVPAEVLPSMYVDK EGGYDLFSLFRRCRESKAIIINTFEELBPYAINSLRMDSMIPPIYPVGPILNLNGDGQNSDEA AVILGMLDDQPPSSVVFLCFGSYGSFQENQVKEIAMGLERSGHRFLWSLRPSIPKGETKLQLKY SNLKEILPVGFLDRTSCVGKVIGWAPQVAVLAHKAVGGFVSHCGWNSILESVWIDMSVATWPMY GEQQLNAFEMVKELGLAVELEVDYRNEYNKTGFIVRADEIETKIKKLMDEKNSEIRRKVKEMK EKSRVAMSENGSSYTSLAKLFEKIM | 1080 | KM491309 |
| PgUGT71A27 coding DNA [Panax ginseng] | ATGAAATCTGAATTGATTTTCTTGCCAGCTCCAGCATCCAGCTTCCATTGGTCATTGGTGGTGATGGTTGAAA TGGCAAAGTTGTTTATTTCTAGACATGAAAATTTGTCAGTTACTGTTTTGATCGCTAAGTTCTA CATGGATACAGGTGTTGATAACTACATAAGTCTTTGTTGACTAATCCAACACCAAGATTGACT ATTGTTAATTGCCAGAAACAGATCCACAAAACTACATGTTGAAGCCAAGACATGACTAATCTTCC CATCTGTTATTGAAACTCAAAAGACTCATGTTAGACAGATATCATCTGGTATGACTCAATCGA ATCAACAAGAGTTGTTGGTTGTTGTTATTAACATCGGATATCGCTAAC GAATTCAAATGTTCCAACTTACGTTTACTCTCCAGCTGGTCGCAGTCATTGGGTTTAGCTTCC ATTTGCAAACATTGAACGATAAGAACAAGAGTTACTGAAGTTTACCATCTATGTACGTTGATAAG GTTAGTTCCATCATTTGCAAATCCAGTTGTCTTTCTTTGTTTTAGAAGATGTAGAGAATCAAAGGCAATCATTA TTAACACTTTCGAAGAATTGGTCCAATTTGAATTGAATGTGACGGTCAAGCTCAATCTATGA GCAGTATTTTGGGTTGCTTAGATCAACAACCATCTCAGTTGTTTTCTTTGTTTCGGTT CTTACGGTTCATTCCAAGAAAACCAAGTTGAAGAAATCGCTACGTGGGTTTGAAAGATCAGGTCA TAGATTTTTGTGGTCTTTAAGACATCTTGCCAGTTGCTGTTTGCCACATAAAAGCTGTTGGTGTTTTCATTG TCTAATTTGAAGGACATCTTGCCAGTTGCTGTTTTGCCACATAAAAGCTGTTGGTGTTTTCATTG TGGTTGGCACCAACAAGTTGCTATCTTGGAACTCAGTTTGGTACGATATGTCAGTTGCTACTTGGCCAATGTAC GGTGAACAACAATTGAACGCTTTCGAAATGTTAAGGAACTTGTTAGCTGTTGAAATCAAG TTGATTACAAGAGAAACGAATACAATAAGAACTGGTTTTATTGTTAGAGCTGATGAAATCGAAACAAA AATTAAGAAATTGATGATGCAATGCAATGGTTCTTCATATACATCATTGGCTAATTATTTG AAAAGATTATGTAA | 1081 | |
| CaUGT3 protein [Catharanthus roseus] | MATEQQQASISCKILMFPWLAFGHISSFLQAKKLSDRGFYFYICSTPINLDSIKNKINQNYSS SIQLVDLHLPNSPQLPPSLHTINGLPPHLMSTLKNALIDANPDLCKIIASIKPDLIIYDLHQPW TEALASRHNIPAVSPSTMNAVSFAVVMHMFNPGLEPPFKAIHLSDFEQARFLEQLESAKNDAS AKDPELQGSKGFFNSTFIVRSSREIEGKYVDYLSEILKSKVIPVCPVISLNNNDQGQGNKDEDE IIQWLDKKSHRSSVFVSFGSEYFLNMQEIEEIAIGLELSNVNPIWVLRFPKGEDTKIEEVLPEG FLDRVKTKGRIVHGWAPQARILGHPSIGGFVSHCGWNSVMESIQIGVPIIAMPMNLDQPPNARL VVEIGVGIEVGRDENGKLKRERIGEVIKEVAIGKKGEKLRKTAKDLGQKLRDREKQDFDELAAT LKQLCV | 1082 | BAH80312 |
| CaUGT3 coding DNA [Catharanthus roseus] | ATGGCTACTGAACAACAAGCATCAATCTCTTGTAAGATCTTGATGTTCCCATGGTTGGCAT TCGGTCATATCTCTTTCATTTTGCAATTGGCTAAGAAATTGTCTGATAGAGGTTTCTACTTCTA CATCTGTTCAACACCAATTAATTGATTCATTCCAAAATCACCACAATGCCACCATCTTACACTACTA TCTATCCAATTGGTTGATTTGCATTGCCAAATTCACCACAATGCCACCATCTTACACTACTA CAAATGGTTTGCCACCACATCGCATCTATTAAACACCAGATTGATCATCTATGATTTGCATCAACCATGG TTTGTGTAAGACTCATGCATCTATTAAACACCAGATTGATCATCTATGATTTGCATCAACCATGG ACTGAAGCTTTGGCATCAAGACATCAACATCCCAGCTGTTTCATTTCTACAAGCACGCTGTTT | 1083 | |

TABLE 1-continued

Some protein and DNA sequences disclosed herein

| Protein/DNA Description | Protein/DNA Sequence | SEQ ID NO | Accessio No./Reference |
|---|---|---|---|
| | CTTTCGCATACGTTATGCATATGTTCATGAACCCAAGGTATCGAATTCCCTTTAAAGCTATCCA TTTGTCTGATTTCGAACAAGCAAGATTTTGAACAATTGGAATCGAATGATGCTTCT GCAAAAGATCCAGAATTGCAAGGTTCAAAGGGTTTCTTTAACTCACTTTATTGTTAGATCAT CTAGAGAAATCGAGGGTAAATACGTTGATTACTTGTCAGAAATCTTGAAGTCTAAAGTTATTCC AGTTTGTCCAGTTATTTCATTGAACAACAACGATCAAGGTCAAGGTAAATAAGGATGAAGATGAA ATCATCCAATGGTTGGATAAGAAATCCATAGATCATCTGTTTCGTTTTCATTCGGTTCTGAAT ACTTTTGAACATGCAAGAAATGCAAGAAATCGTCGTTTTGAATTATCTAACGTTAACTT CATCTGGGTTTTGAGATTCCCAAAGGGTGAAGATACTAAGATCGAAGAAGTTTTGCCAGAAGT TTCTTGGATAGAGTTAAGACAAAGGGTAGAATCGTTCATGGTTGGCCTCCAAGCAAGAATTT TGGGTCATCCATCCATTGGTGGTTTTGTTTCTCATTGTGGTTGAACTCAGTTATGGAATCTAT CCAAATCGGTGTTCCAATCATCCAATGAATTTGATCCATTTTAATGCTAGATTG GTTGTTGAAATTGGTTGTTGGTATTCAAGTTGGTAGAGAATCGGTAGAGAATCGGTAAAACGGTAAATTGAAGAGAGAAA GAATCGGTGAAGTTATTAAAGAAGTTGCAATCGGATAGAGATAGAGAAAAAGCAAGATTTTGAATGAATTGGCTGCAACA TTGAACAATTATGTGTTTAA | | |
| SvUGT74M1 protein [Gypsophila vaccaria] | MSNNENNATQVIVLPYHGQHMNTMVQFAKRLAWKGVHVTIATFNTIQQMKLNISSYNSITLE PIYDDTDDSTLHIKDRMARPEAEAASNLTRVLEAKKQQQALNKKCLLVYHGSLNWALVVAHQQN VAGAAFFTRASASFACYYYLHLESQGKGVDLEELPSILPPPKVIVQKLPKSFLAYGDNNSHNNN NNNNNNNNMGLHPLVLMLLKDYGNSVKADFVLLNSFDKLEEAIKWISNICSVKTIGPTIP STYLDKQIENDVDYGFNQYKPTNEDCMKWLDTKEANSVVYIAFGSVARLSVEQMAEIAKALDHS SKSPIWVVRETEKEKLPVDLIVEKISGQGMVVPWAPQLEVLAHDAVGCFVSHCGWNSTIEALSFG VPILAMPQFLDQLVDAHFVDRVWGVGIAPTVDENDLVTQEEISRCLDEMMGGPEGEKIKKNVA MWKELTKEALDKGGSSDKHIDEIIEWLSSS | 1084 | ABK76266 |
| SvUGT74M1 coding DNA [Gypsophila vaccaria] | ATGTCTAACAACGAA TABLE 1-continued Some protein and DNA sequences disclosed herein

| Protein/DNA Description | Protein/DNA Sequence | SEQ ID NO | Accessio No./Reference |
|---|---|---|---|
| MtUGT73F3 protein [Medicago truncatula] | MEGVEVEQPLKVYFIPFLASGHMIPLFDIATMFASRGQQVTVITTPANAKSLTKSLSSDAPSFL RLHTVDFPSQQVGLPEGIESMSSTDPTTWKIHTGAMLLKEPIGDFIENDPPDCIISDSTYPW VNDLADKFQIPNITPNGLCLFAVSLVETLKTNNLLKSQTDSDSSFVVPNFPHHITLCGKPP KVIGIFMGMMLETVLKSKALIINNFSELDGEECIQHYEKATGHKVWHLGPTSLIRKTAQEKSER GNEGAVNVHESLSWIDSERVNSVLYICFGSINYFSDKQLYEMACAIEASGHPFIWVPEKKGKE DESEEEKEKWLPKGPEERNIGKKGLIIRGWAPQVKILSHPAVGGPMTHCGGNSTVEAVSAGVPM ITWPVHGDQFYNEKLITQFRGIGVEVGATEWCTSGVAERKKLVSRDSIEKAVRRLMDGGDEAEN IRLRAREFGEKAIQAIQEGGSSYNNLLALIDELKRSRDLKRLRDLKLDD | 1086 | ACT34898.1 |
| MtUGT73F3 coding DNA [Medicago truncatula] | ATGGAAGGTGTTGAAGTTGAACAACCATTGAAGGTTTACTTCATCCCATTTTTAGCTTCTGGTC ATATGATCCCATTGTTCGATATCGCAATGATGTTCGCATCAAGAGGTCAACAAGTTACTGTTAT TACTACACCAGCTAACGCAAAGTCATTGACAAAGTCTTTATCTTCAGATGCACCATCATTTTTG AGATTGCATACTGTTGATTTTCCATCTCAACAAGTTGGTTTACCAGAAGGTATTGAATCAATGT CTTCAACTACAGATCCAACTACAACTTGGAAGATCCATACTGGTCGTATGTTGTTGAAGGAACC AATCGGTGACTTCATCGAAAACGATCCACCAGATTGTATCATCTCAGATTCTACATACCCATGG GTTAATGATTTGGCTGATAAGTTCCAAATCCAAACATCACTCTTTAATGGTTTGTGTTTCG CAGTTTCTTTGGTTGAAACATTGAAGACATTAACAATTTTGTTGAAGTCACAAACAGATTCAGATTC TGAATTCTTTATGGGTATGATGCTTGAAAACATTAATATCACTTTTGTGGGTAAACCACCA AAAGTTATTGGTATTTTTATGGGTATGATGTTGGAAACAGTTTTGAAGTCAAAGGCTTTGATTA TTAACAATTTTCTGAAGTTGGGTCCAACATCATTGAATGTCAAGAAGACTTGCTCAAGAAGGCAACAGGTCA TAAGGTTTGGCATTTGGGTCCAACATCATTGAATGTCATGAATTCTTCGGTTAGAGCTCAAGAAGGTAATT CTGTTTTAATACATTGTTTGGTTCAATTAATTACTCTTCTGAATAAGCAATTGTACGAAATGGC TTGTCAATTGAAGCTTCTGGTCATCCTTTTATTTGGGTTGTTCCAGAAAAGAAGGTAAAGAA GATGAATCAGAAGAAGAAAGGAAAAGTGGTTGCCAAAGGTTTCCAAAGGTTCCAAGAGTTGG AAAGGGTTTGATCACACATTGTGGTGCTAATTCAACTGTGAAGCTGTTTCTGCAGTTGTCCAATG TGGTTTATGCACCAGTTCATGGTGACCAATTCTACCAATGTATCACTCAATTCAGAGGTA ATTACATGGCCAGTTCATGGTGACCAATTCTACCAATGTATCACTCAATTCAGAGGTA TTGGTGTTGAAGTTGGTGCTACAGAATGGTGTACTTCTGGTGTTGCAGAAAGAAGAAATTGGT TTCAAGAGATTCTATCGAAAAGGCAGTTAGAAGTTGATGATGTGGTGAGCTGAAAAC ATCAGATTGAGACGCAAGAAATTTGGTGAAAAGCTATTCAAGCAATTCAAGAAGGTGGTTCAT CTTACAACATTGTTGCGTTTGATTGATGAATGAATTAAAAAGATCTAGAGATTTGAAAAGATTAAG AGATTTGAAATTAGATGATTAA | 1087 | |
| GmUGT73F2 protein [Glycine max] | MDLQQRPLKLHFIPYLSPGHVIPLCGIATLFASRGQHVTVITTPYYAQILRKSSPSLQLHVVDF PAKDVGLPDGVEIKSAVTDLADTAKFYQAMLLRPISHMDQHPPDCIVADTMYSWADDVANN LRIPRLAFNGYPLFSGAAMKCVISHPELHSDTGPPVIPDPPHRVTMPSRPPKMATAFMDHLLKI ELKSHGLIVNSFAELDGEECIQHYEKSTGHKAWHLGPACLVGKRDQERGEKSVVSQNECLTWLD PKPTNSVVVVSFGSVCHFPDKQLYBIACALEQSGKSFIWIVPEKKGKEYENESEEEKEKWLPKG FEERNREKGMIVKGWAPQLLILAHPAVGGFPLSHCGWNSSLEAVTAGVPMITWPVMADQFYNEKL ITEVRGIGVEVGATEWRLVGYGEREKLVTRDTIETAIKRLMGGGDEAQNIRRRSEELAEKAKQS LQEGGSSHNRLTTLIADLMRLRDSKSAT | 1088 | BAM29362.1 |
| GmUGT73F2 coding DNA [Glycine max] | ATGGATTTGCAACAAAGACCATTGAAGTTGCATTTCATCCCATATTGTCTCCAGGTCATGTTA TTCCATTGTGTGGTATTGCTACATTATTTGCATCAAGAGGTCAACATGTTACTGTTATTACTAC ACCATACTACGCTCAAATCTTGAGAAATCTTCACCATCTTTGCAATTACATGTTGTTGATTTT CCAGCTAAAGATGTTGGTTTACCAGATGGTGTTGAAATTAAATCAGCAGTTACAGATTTGGCTG ATACTGCAAAATTTTACCAAGCTCAATGTTGCTTGTTGAGAAGACCAATCTCATTTCATCGATCA ACATCCACCAGATTGTATCGTTGCTGATACAATGTACTCATGGGCTGATGATGTTGCAAACAAT | 1089 | |

TABLE 1-continued

Some protein and DNA sequences disclosed herein

| Protein/DNA Description | Protein/DNA Sequence | SEQ ID NO | Accessio No./Reference |
|---|---|---|---|
| | TTGAGAATCCCAAGATTGGCTTTTAATGGTTACCCATTATTTCTGGTGCTGCAATGAAGTGTG<br>TTATCTCTCATCCAGAATTGCATTCAGAATGCTACTGGTCCATTTGTTATTCCAGATTTTCCACATAG<br>AGTTACAATGCCATCAAGACACCACAAAATGGCTACTGCTTTATGCACATTGTTGAAGATC<br>GAATTGAAATCTCATGGTTTGATCGTTAACTCATTCGCTGAATTAGATGCTGAAGAATGTATCC<br>AACATTACGAAAAATCTACAGGTCATAAGGCTTGGCATTGGGCTCCAGCATGTTTAGTTGCTTAA<br>AAGAGATCAAGAAACGAGGTGAAAAATCTGTTGTTTCACAAAACGAATGTTTGACATGGTTAGAT<br>CCAAAGCCAACTAACTCAGTTGTTTACGTTTCTTGGTTCAGTTTGTCATTTCCAGATAAGC<br>AATTGTACGAAATTGCTTGTGCATTGGAACAATCGGTAAATCTTTTATTTGATCGTTCCAGA<br>AAAGAAAGGTAAAGATACAGAGAAAACGAATTGAAGAACAAAAGGAAAAGTGGTGCCAAAGGGT<br>TTCGAAGAAAGAAACAGAGAAAAGGTATGATTGTTAAAGGTTGGGCTCCACAATTGTTAATTT<br>TGGCTCATCCAGTGGTGGTTCTTGTCTCATGTGGTCTGGAATTCTTCATTGGAAGCTGT<br>TACAGCAGGTGTTCCAATGATTACTTGGCCAGTTATGCCTGATCAATTCTACAACGAAAAGTTG<br>ATCACAGAAGTTAGAGGTATTGGTGTTGAAGTTGCTGCAACTGAAACTGAAGAGATTAGTTGTTACG<br>GTGAAAGAGAAGAAGAAAGTTGGTTACTAGAGATACAATCGAAACTGTCTATTAAAGATTGATGGGTGG<br>TGGTGAGAAGCACAAAACTGAAGAAGATCTGAAAGAATTGGCTGAAAAACAAAACAATCA<br>TTACAAGAAGGTGGTTCTTCACATAACAGATTGACTTACATTGCTGATTTGATGAGATTGA<br>GAGATTCTAAGTCAGCAACTTAA | | |
| UGT73C26 protein [Barbarea vulgaris] | MASEKPHQCHPSLHVLFPMAQGHMIPMIDIARLLAHRGPKITIVTTPQNAARFKNVLSRSID<br>SGLPINVVHVKLPYQEAGLPEGQENADLLDSTEFMVPFFKAVNMLEEPVMKLMEEMKPRPSCLI<br>SDFCLPYTSKIAKKFNIPKIVFHGMGCFCLLCLVLRQNLEILQNLKSDKEYFWMPSPDRVEF<br>TKPQVPVRTNASGDMKVFLDERVKGEETSYGVIVNTFQELEPAVVNDYKKARAGKVWSIGPVSL<br>CNKVEADKAERGNKPVINQEQCIKWLDSKEEGSVLYVCLGSICNLPLPQLKELGLGLEESQRPF<br>IWVTRGWEKYDELSEWLLESGFEERTKERGLLIKGWSPQMLIISHPAVGGFLTHCGWNSTLEGI<br>TSGVPLLTWPLFGDQFCNQKLVVQVLKVGVSAGVEEVMEWGDEEKIGVLIDKEGVKKAVEELMG<br>ESDDAKERRKRVKELGELAHKALEBGGSSHSNITLFLQDIMQQVESRTD | 1090 | AVW82168.1 |
| UGT73C26 coding DNA [Barbarea vulgaris] | ATGGCTTCTGAAAAACCACATCAATGTCATCCATCAATGTCGTTTTGTTCCCTTTATGG<br>CACAAGGTCATATGATCCCAATGATCGATATCGCTAGATTGTTGGCACATAGAGGTCCAAAGAT<br>CACTATCGTTACTACACCACAAAACGCTGCAAGATTCAAAAACGTTTGTCTAGATCAATCGAT<br>TCTGGTTTGCCAATTAATGTTGTTCATGTTAAGTTGCCATATCAAGAAGCTGGTTACCAGAAG<br>GTCAAGAAAACGCAGATTTGTTGGATTCAACTGAATTCATGGTTCCATTTTTCAAGGCTGTTAA<br>CATGTTGGAAGAACCAGTTATGAAGTTATGATGGAAGAAATGAAGCCAAGACCATCTGTTTGATC<br>TCAGATTTCTGTTTGCCATACAATCTAAAATTGCTAAAAAGTTAATATCCAAAGATCGTTT<br>CCAATGGTATGGGTTGTTCTGTTGCTCCATCATCCAGATAGAGTTGAATTT<br>GCAAATTTGAAATCTGATAAGATATCTTTGAAGCTCTTGTTGATGCTGAAAATTCCAGATAGAGTTGAATTC<br>ACTAAACCAAGTTCAGTTAGAACAAATGCTTCGGTGACTGGAAAGTTTTCTGGATGAAA<br>GAGTTAAAGGTGAAGAAACTTCATATGGTGTTATTGTTAACACATTCAAGAATTAGAACCAGC<br>ATACCGTTAACGATTACAAGATAAGCTAGAGCTGGTAAAGTTGGTCATTGTCCAGTTCATTG<br>TGTAATAAGGTGAAGCTGATAAAGCAGAAAGAGGTAATAAGCCAGTTATTAATCAAGAACAAT<br>GTATCAAGTGGTTGGATTCTAAAGAAGAAGAATTGGGTTTAGGTTTGAAGAATCACAAAGACCTTT<br>TAATTTGCCATTGCCACAATTGAAGAAAAATACGATGAATTGCTGAATTGTCTGAATTGGAAGTT<br>TCGAAGAAAGAAAGAAGAGGTTGTTGATTAAAGGTTGGTCTCCACAAATGTTAATTT<br>GTCACATCCAGCTGTTGGTGGTTTCTTGACTCATTGTGGTTGGAATTCTACTTAGAAGTATT<br>ACATCAGGTTGTTCCATTGTTAACATGGCCATTGTTCGGTGACCAAGAAGGTATGGAAGTTGG<br>AGAAGAGATTGGTGTTTGACGCAAGAAAGAGAAGAGTAAGGAAGCTGTTGAAGAATTAATGGGT<br>GAATCGATGATGCAAAGCAAAGAGAAGAGAAGAGAGTAAGGAATTGGGTGAATTAGCTCATAAG | 1091 | |

TABLE 1-continued

Some protein and DNA sequences disclosed herein

| Protein/DNA Description | Protein/DNA Sequence | SEQ ID NO | Accessio No./Reference |
|---|---|---|---|
| | CATTAGAAGAAGGTGGTTCTTCACATTCTAACATCACTTATTTTGCAAGATATCATCAACA AGTTGAATCAAGAACAGATTAA | | |
| UGT73C27 protein [Barbarea vulgaris subsp. arcuata] | MASEKSHLFDPSLHFVIPPRMAQGHMIPMIDIARLLAQRGAKITIVINPHNAARFYNVLSRSIE SGLPINLEHVKLPYQEAGLSEGQENIDSLDSMELMVPFIKAVNLLEEPVMKLMEEIKPRPSCLI SDLLLPYTSKITKKFPNIPKIVFHGMGCFCLLCMHVLRRNIEILKNLKSDKDYFLVPSFPDRVEF TKPQVPVETNASGDWKEFLDEMVEAEDTSYGVINTFQELEPAYIKDYKEAKAGKVWSIGPVSL CNKIGADKAERGNKAAIEQDECLKWLDSKEEGSVLIYVCLGSICNLPLAQLKELGLGLEESQRPF IWVTRGWEKYDELYEWMLESGFEERTKDRGLLIRGWAPQVLILSHPSVGGFLTHCGWNSTLEGI TSGVPLLTWPLFGDQFCNQKLIVMQVLKVGVSTGVEEIMKWGEEEKIGVLVDKEGVKKAVEELMG ESDDAKERRKRVKELGKLAHKAVEEGGSSHCNITLFLQDICQLQSVKYFK | 1092 | AVW82172.1 |
| UGT73C27 coding DNA [Barbarea vulgaris subsp. arcuata] | ATGGCATCTGAAAAATCACATTTGTTCGATCCATCTTGCATTTCGTTATCTTCCCTTTTATGG CTCAAGGTCATATGATCCCAATGATCGATATTGCTAGATTGTTGGCACAAAGAGGTGCTAAGAT CACTATCGTTACAAACCCACATAACGCTGCAAGATTCTACAACGTTTTGTCTAGATCAATCGAA TCTGGTTTGCCAATTAATTTGGAACATGTTAAGTTGCCATACCAAGAAGCAGGTTTGTCAGAAG GTCAAGAAAACATCGATTCTTTGGATTCAATGGAATTAATGGTTCCTTTTATTAAGGCTGTTAA TTTGTTGGAAGAACCAGTTATGAAGTTGATGGAAGAAATTAAACCAAGACCATCTTGTTTGATC TCAGATTTGTTATTGCCATACACTTCAAAGATCACTAAAAAGTTTAATATTCCAAAGATCGTTT TCCATGGTATGGGTTGTTTCTGTTTGTTGTGTATGCACGTTTCCATCATTTCCAGATAGTTTGT GAAAAATTTGAAGTCTGATAAGGATTACTTTTGGTTCCAAGTTTCCAGATGAATTTTGGATGAA ACTAAACCAAGTTCCAGTTGAACAACAAATGCATCTGGTACTGGTGAAGAATTTTGGATGAAA TGGTTGAAGCTGAAGATACTTCAAGAGATTCTACAACGTTTTGTCTAGATCAATCGAA TTACATCAAGGATTACAAGGAAGCTAAAGCTGGTAAAGTTGGTCTATTGGTCCAGTTTCATTG TGTAATAAGATTGGTGCTGATAAAGCAGAAGAGGTTCAGTTTGTACGTTTGTTTGGGTTCATCTG GTTTGAAGTGGTTGGATTCTAAAGAAGGTAATTAGGTTTGGGTTGGAAGAATCACAAAGACCTTTT TAATTTGCCATTGCCACAATTGAGAGGTTGGAAAAGTTACGATGAATTGTACGAATGATGTTGGAATCTGTT ATTTGGTTACTAGAGGTTGGGAAAGATAGAGGTTTGTTGATCAGAGGTTGGGCTCCACAAGTTTTGATTTT TCGAAGAAAGAACAAAGGATGAGGTTGTGTTTCTTGACCAGGCTGTTGGAATTCTACTTTAGAAGGTATT ATCTCATCCATCAGTTGGTGTGTTTCGATGACATGGCCATTGACATGGACCAATTCTGTAACCAAAAGTTGG TTATGCAAGTTTGAAAGTTGGTGTTTCTACTGGTGTTGAAGAAATCATGAAGTGGGGTGAAGA AGAAAAGATTGGTGTTTTGGTTGATAAAGAAGGTGTTAAGAAGCAGTTGAAGAATTAATGGGT GAATCAGATGATGCTAAGGAAAGAAGAAAGAGAGTTAAGGAATTGGGTAAATTGGCTCATAAAG CAGTTGAAGAAGGTGGTTCTTCACATTGTAATATTACATTGTTTTTACAAGATATTGTCAATT ACAATCTGTTAAATATTTTAAATA | 1093 | |
| UGT superfamily protein [Citrullus lanatus (Watermelon)] | MDVHKAKDKPTTILMFPWIGYGHLSAYLELAKAVSRCRNNFQIYFCSTPVNLDSIRPKLVASSS SSSSSIQFVELHLPSSPEFPPHLHTTNALPPHLTPTLHQAFAAAAPRFESILQTLSPHLLIYD VLQPWAPRIASSLNIPAINFNTTATSIISHALHNINYPNSKFPLSDFVLHNYWKAKYTNVDGTT TERGRVREAFLYCLTASHDVILINSFKEMEGKYMDYLSVMLKKRVIAVGPLIVEPSEDEDEED EDYSRIKNWLDKKFASSTVLVAFGSEFFPSKEEMEEIAIGLEKSGANFIWVVRFPKGEERKRIE ELLPEGFVERAGERAMVEKDWAPQGKILKHRSIGGFVSHCGWNSVMESIMLGVPVIGVPMHVDQ PYNAGLLEEAGVGVEAKRDPDGKIQRQEIANLIRQVVVDKSREDLRMKVREMSEILRRKGDQKI DEMLTQISLLLKI | 1094 | Cla003152 |
| UGT superfamily protein [Citrullus lanatus | MAADKQTTKKILMLPWLAHGHITPFFELAKRLSKSFQIYLCSSPINLQAINPTLARDHSIELIS LHLLSLPDLPAHMHTTKGIPLHLEPTLVKAFDMAAHGFELLLDRLAPDLVVSDLFQPWAVRSAS SRNIPVVSFVTGVAVLARLVNGFWNNGQEFPFPEVDLSHWVSKSSVRKVCDEVGHDWAMRFF | 1095 | Cla020503 |

TABLE 1-continued

Some protein and DNA sequences disclosed herein

| Protein/DNA Description | Protein/DNA Sequence | SEQ ID NO | Accessio No./Reference |
|---|---|---|---|
| (Watermelon)] | ECMRMSCDVALVNTSPEFEGKYIEFLASSLKKKVLPIAPLIPQIEPNNEKSEILEWLDRKTPKS TVYVSFGSEYYLTKQDREELAHGLHQSGVNFIWIRFPKGQNLLIQEALPNDFLTQIEGKGLIL NEWVPQLKILNHSSIGGFVCHCGWNSVVESMVFGVPIVALPMQLDQPYHAKVVECAGVCVEAKR DGEGNVKREEIVKAIKEVMFEKSGEALRGKAREIGEALRKREEGIIDEVVDEFCKLWEPESKGV | | |
| UGT superfamily protein [Cucumis sativus (Wild cucumber)] | MAENKGLHVVVFPWSAFGHLIPHQLSIALAKAGVHVSFISTPKNLQRLPIPPSLSSFITLVP IPLPKLPGDPLPEGAEATVDIPFKLPIFLKVALDLTEPPRKFIADHAHPDWFIVDFNVSWIG DISREFRIPIVFFRVLSPGFLAFYAHLLGNRLPMTEIGSLISPPPIEGSTVAYRRHEAVGIHAG FFEKNDSGLSDYERVTKINTACRVIAVRTCYEFPDVDYLKLYSNYCGKKVIPLGFLPPEKPPKTE FEANSPWKSTFEWLDQQNPKSVVFVGFGSECKLTKDQIHEIARGVELSELPFMWALRQPDWAED SDVLPAGFRDRTAEBRGIVSMGWAPQMQILPMPAIGGSFFHGGWGSAIAELEFGNCLILLPFIVD QPLNARLLVEKGVAIEVERNEDDGCSSGEAIAKALREAMVSEEGEKIRRKAKEVAAIFGDTKLH QRYIEEFVEFLKHREDPIPNQ | 1096 | CSPI03G08620.1 |
| UGT superfamily protein [Cucumis sativus (Wild cucumber)] | MELDGHHRNKKMKILMLPWLAHGHVSPFLELSKLLATKNFHIFFCSTSIILHSIRSKLPQKLL SSSNIQLVELTLPTSADLPRWRHTTAGLPSHLMFSLKRAPDSAASAFDGILQNLKPDLVIYDFL QPWAPAVALSADIPAVMFQCTGALMAAMVTNMLKFPNSDFLSTPEIRLSEFEIKQLKNLFKSS VNDAKDKQRIEECYKRSCGILLLKSLREIEAKYIDFVSTSLQIKAIPVGPLVEEQEEDIVVLAE SFEKWLNKEKRSCILVSFGSEFYLSKGDMEEIAHGLELSHVNFIWVRFPGSGEQGERKKKKN VVEEELPKGFLERVGERGMVVEEENVPQVQILKHRSTGGFLSHCGWSSVLESIKSGVPIIAAPMQ LDQPLNARLVEHLGVGVVVERSDGGMLCRREVARAVREVVAEESGKRVREKVKEVAKIMKEKGD EGEMEVVVEEITKLCRRKRKGLQSNWCRTSMDSHCCEVMED | 1097 | CSPI06G03850.1 |
| UGT superfamily protein [Cucumis melo (Melon)] | MSNGDVLHVVLFPWLAFGHLIPFARLAICLAQKGFKVSFISTPRNLRIPKISPHLSSVVSLVG VSLPLFDGLPVAAEASSDVPYNKQQLLKKAFDSLESQLADLLRDLNPDWIIYDYASHWISPLAA ELRISSVFFSLFTAGFLAFLGPPSELSNGRGSRSTVEDFMEVPEWMSHGSNLRFPRYHELKTSLD GAIGNESGCTSDSVRFPGVSIEESVAVAVRSSPELEPESFDLLTKLYQKPVIPIGFLPPLTEDVEE LSEDIEQWEDVLKKQKTNSVLYVSFGSFTEAFLSQEDVTELAYGLEQSEIPFLWLRTSHRNESEMLPA GFKERISGRGLVHEGWISQVKVLSHDSVGGCLTHCGWNSIIEGLGYGRVMIMCPVVNDQGLNAR ILEKEMVGIEIERNERDGSFTRESVSESVRSAMAEGSGGGKLLRERAMEMKGLFGNGDNERDL DKLVDFLKTNRKNAA | 1098 | MELO3C003508P1 |
| UGT superfamily protein [Cucumis melo (Melon)] | MTGDKNLHIVMFPWLAFGHMIPYLELSKLLIAQKGHRVSFVSTPKNIDRLPTQLPPHLSPPLSFV KIPLPQLHNLPPDAEATSDLPYDKVQFLKEAFDALKQPLSDFLRTSDADWIVYDFVPYWIGQEV GPNLRIKTAFFSIFILQSLAFVGPMLGDRRMKLEDFTVPPDWIPFPTTVAFRHFEIKKLFDFVA GNTTGVSDIDRFMSAHYSDLVVTPAGFEPEYEPEWIQLLEDIHDKTVIPVGQLPTSEHDSKEDNR SWQSIKEWLDKQAKGSVVVVAFGSEAKPSQHELTEIALGLEKSRPPFWVLRTRIGLSDDPPIE LPEGFEERTKGQGVVCTTWAPQLKILGHESVGGFLTHSGWSSVVEAIQSERALVLLSFLADQGI IARVLEEKMGYCVPRSQLDGSFTRDSVAESLKLVMVEEEGKIYRERIREMKDLFVNKERDEKL MDGFLSYLKKHRNVDDEDH | 1099 | MELO3C007706P1 |
| beta-1,6-glucosyltransferase-like [Juglans regia] | MDTARKRIRVVMLPWLAHGHISPPLELSKLLAKRNFHIYFCSTPVNLSSIKPKLSGKYSRSIQL VELHLPSLPELPPQYHTTKGLPPHLNATLKRAFDMAGPHFSNILKTLSPDLLIYDFLQWAPAI AASQNIPAINFLSTGAAMTSFVLHAMKKPGDEFPPEIHLDECMKTRFVLPEDHSPSDDHNHI SDKDRALKCFPEQSSAVFVSPGTEYFPLSKEEMEEIAYGLELSNVNFIWVRFPEGEKVKLDEALPEGFLQR LDKRKQSSAVFVSPGTEYFPLSKEEMEEIAYGLELSNVNFIWVRFPEGEKVKLDEALPEGFLQR VGEKGMVVEGMAPQAKILMHPSIGGFVSHCGWSSVMESIDFGVPIVAIPMQLDQPVNAKVVEQA GVGVEKKRDGKLREEVATVIREVVMGNIGESVRKKEREMRDNIRKKGEEKMDGVAQELVQL YGNGIKNV | 1100 | XP_018827544.1 |

TABLE 1-continued

Some protein and DNA sequences disclosed herein

| Protein/DNA Description | Protein/DNA Sequence | SEQ ID NO | Accessio No./Reference |
|---|---|---|---|
| UDPGT domain-containing protein [Cephalotus follicularis] | MDLKRRSIRVLMLPWLAHGHISPFLELAKKLINENFLIYFCSTPINLNSIKPKLSSKYSFSIQL VELHLPSLPELPPHYHTTNGLPLHLMNTLKTAFPDMASPSFLNIILKTLKPDLLICDHLQPWAPSL ASSLNIPAIIFPTNSAIMWAFSLHHAKNPGEEFPPPSINNDMVKSINFLHSASNGLTDMDRV LQCLERSSNTMLLKTFRQLEAKYDYSSALLKKKIVLAGPLVQVPDNEDEKIEIIKWLDSRGQS STVFVSFGSEYFLSKEEREDIAHGLELSKVNFIWVRPPVGEKVKLEEALPNGFAERIGERGLV VEGWAPQAMILSHSSIGGFVSHCGWSSMMESMKFGVPIIAMPMHIDQPLNARLVEDVGVGLEIK RNKDGRFEREELARVIKEVLVYKNGDAVRSKAREMSEHIKKNGDQEIDGVADALVKLCEMKTNS LMQD | 1101 | GAV83746.1 |
| beta-D-glucosyl crocetin beta-1, 6-glucosyltransferase-like [Prunus avium] | MVYSQQRSTIILMLPWLAHGHISPFLELAKKLTSKRNFHIFICSTPVNLLSIKPKLSPKYSHCI EFVELHLPHEELPELPPHYHTTNGLPPHLMSTLKRAFDMSSNNFSTILTTLKPDLLIYDFLQPW APSLASLQNIPSVEFITTSAAMTSFGVHHLKNPSAKFPPPSINLRDYEAQKFNNLLESSSNGIK DGDRIQQCSDLSSDIILVKTSREIEAKYVDYLSGVMGKKIVPVGPLVQEPMDLKVDEETWIMKW LNKRRERASVVYVGFGSEYFLTKEEIEEIAHGLELSKASFIWVIRFPKEEKGRRVEEVLPGEFLE RVGEKGIIVEGWAPQAKILKHSSVGGFVSHCGWSSVLESIKFGVPIIAMPMHLDQPINSRLVEE AGVGVEVKRTAEGSRQREEVAKVIRDVVVEKIGEGVRKKALEIRDNMKKKEDAEIDGVVEELMQ LCTKRGSNVNF | 1102 | XP_021818209.1 |
| beta-D-glucosyl crocetin beta-1, 6-glucosyltransferase-like [Quercus suber] | MEATHNTISVLMLPWLAHGHISPFLELAKKLTTRNIHIYFCTTPINLGPIKQQQLSEKDSLSIE LVELHLPSLPELPPHYHTNGLPPHLMPTLKKAMDMASPNITNILTQLKPDLVIYDFLQILAPS LAQSONIPAVNFVVMSATIVSFYMHFANNPGVEYPSPEIYLQDHEVGKFANDTDDGDRILECFQ QSSEIVLIKTFQEIEAKHIDYLSVLAKKKIVPVGPLVQDPVEEDEKKGIIEWLNDKEPSSAVFV SFGSEYFLSKEETEEIAYGLELSMVPFIWVRPPRGEKVNLQMALPKGFLDRVGDRGMVIEGWA PQKTILKHSSIGGFVSHCGWSSVMESMKFGVPIIAMPMHLDQPVNARLVEAIGAGVEVKRDKKG RLEREEVAKVIRKVLVENTTKRAKELKENIENKGDEEIVGVVQELLRLCSKLKE | 1103 | XP_023881565 |
| beta-D-glucosyl crocetin beta-1, 6-glucosyltransferase-like [Citrus sinensis] | MNNRQRNYCVLMFPWLAHGHVFPFLELTTKFTKRSNFYIYFCSTPAILDSIKLSDNFSLSIQLI ELHLPSLPELPPHYHTTKGLPLHLMPTLKKAFDMASSSFFNILKNVNPDLLIYDFIQPWAPTLA LSLNIPSVLFLTSSATMGGFLFHTFEKTPSEDDGEFPPFSSIFIHEYMKPKFSHLVDSSSNGIKD KDKFLQCCDDSSCNVILIKTPRDLQQKYIDYLSVLMKKKLVPVGPLVEDDPVEEDDHEEGIEIQW LDKKERSSTVFVSFGSEYFLPKEEMEGIALGLEFSGVDFIWVVRFPSGVKVKVDEELPKHFLER TKERAMVEGWAPQOMKILGHXGGFVSHCGWSSMKLGVPIIAMPMHLDQPLNARLVEDVGV GMEVRRNENGRIEREEMARVIKEVVVEKNGEKLRRKAREMSENIRKKGDEEIDEVVDELSQLSG | 1104 | XP_015380577.1 |
| UGT superfamily protein [Lagenaria siceraria (Bottle gourd)] | MASHDHGTPHFLLPPFMAQGHMIPMIDLAKLLASRGAIITIVTTPLNSARFHSVLTRAIHSGLQ IHVLELQPPTCQETGLPQGCENVDLLPSLASLSQPFYRAASLLYGPSEKLFQQLNPRPNCIISDM CLPWTFQLAQKFHVPRLVFYSLSCFFLLCMRSLIANIDFLKPIPDSEFVALPDLPFPVEFRRSQ LYKSTDDYLTQFSLAMWEADRQSYGVVLNVFEEMMEPEHVTEYIKGRESPEKVWCIGPLSLSNDN ELDKAERGDKSSIDGHECMKWLDGQNPSSVVYVSLGSLCNLGTSQIIELGLGLEASKKPFIWVI RKANLTANLLKWVEBYDFEEKTKGRGVVIRGWAPQVLILSHSSIGCFLTHCGWNSSIEGISAGV PMITWPLFADQVFNYKLIVEILKGVSVGEETETNWEKEGEGERVVKKEKVREAIEMVMDGD EREEMRKRCKEIGERKAKRAVKEGGSSHRNLSRLIEDISAHVFVHGESFENGRS | 1105 | Lsi03G019760.1 |
| UGT superfamily protein [Cucumis sativus (Cucumber)] | MASPPHFLLPPFMAQGHVIPMIDLAKLLAHRGVIITIVVTPTNAARNHSVLDRAIRSGLQIRMI QLPPPSKEGGLPEGCDNLDLLPSRKFASKFFRATSFLYQPSEDLFHQLKPRPICIISDTYLPWT FQLSQKFQVPRLVYSTFSCFCFLCIHCLMINPALSISDSDSVIFSDFTDPVEFRKSELPKSTDE DILKFTSEIIQTDAQSYGVIFNTFVEMEYNYITDYRKTRQKSPEKVWCVGPVSLYNDDKLDLLE RGGKASINQQECINWLDEQQPSSVYVSLGSLCNLVTAQLIELGLGLEASNKPFIWSIREANLT | 1106 | CsGy3G031540.1 |

TABLE 1-continued

Some protein and DNA sequences disclosed herein

| Protein/DNA Description | Protein/DNA Sequence | SEQ ID NO | Accessio No./Reference |
|---|---|---|---|
| UGT superfamily protein [Cucumis sativus (Wild cucumber)] | EELMKMLEEYDLEGKTKGKGLVICGWAPQVLILTHSAIGCFLTHCGWNSSIEGISAGVPMITWP LFGDQIFNYKLIVDVLKVGVSVGVETLVNWGEEDEKGVVVKREMVREAIEMVLEGEKREMRER SKKLAEIAKRGMEEGGSSYKDITMVIEDIIGNGGC MASPHFLLFPFMAQGHMPMIDLAKLLARGVITIVITPHNAARNHSILSRAIHSGLQINVVQ LPFPCLQGGLPEGCENLDLLPSLDLIASKFLRAIFFLLDPSAELFQKLIPRPTCIISDPCLPWTI KLAHKFHIPRIVFYSLCCFSLLCQPTLVNKEPLLRSLPDQALVTVPDLPGYDFQPRRSMLPKHT DQYFAAFNREMEEADLKSYSIIINTFEELEPKNLAEYRKLRDLPEKVWCIGPVSLCNHDKLDKA ERGNKSAIDQHECLKWMDWQPPSSVVYVSLGSICNITTRQLIELGLGLEASKRPFIWVIRKGNE TKELQKWMEAYNFKEKTKGRGLVIRGWAPQVMILSHTAIGSFLTHCGWNSTLEGISAGVPMITW PLFSDQFNNEVLIVRMLKNGVSVGVEASLQWGEEEEIEVAVKKEDVMNAIERVMSGTKEGEEIR ERCKELGKKANRAVEEGGSSHHNIKLFIDDLIDLAGGDPN | 1107 | CSPI06G02690.1 |
| UGT superfamily protein [Cucurbita maxima (Rimu)] | MASKSKQPPHFLLLIPLMAQGHLIPMADLAKLLAENGARVSLITTPQNASRINSLLSHPNQSQIQ ILHLQFPSHQQSGFPQGCENFDSLPSLLPKFLSATALFCRAATEDLFQQLSPRPSCVVSDMAL PWTIKVAHKFNVPRLVFYSLSSLYLLGMANLRATCGVIDKIMSASDSERIVIPNLPDKVELTKPQ FICTLDAGFMEWANEMGKADQASYGVIVNSFDGLEPKYLEELKKAIGSEKVWCVGPVSLCNKDT TDKAIRGNKAALDEHECLKWMLDRQQPGSVVYAALGSLCNIIAAQIIELGLALEALNRPFIWVIR QTEATNNELEKWLSESGFEERTKERGLVVRGWAPQLLILSHPAAGAFVTHCGWNSTIEGITAGV PMVAWPLFADQIFNEKLIVQLLKVGVSVGMEKSVMWGSEEEIGVQVKMEGIRGAIEKVMDGDGN KEMRRRVRDLAERAKAAMEEGGSSHLNLKLIEDIMHEAEARESHK | 1108 | CmaCh06G004110.1 |
| UGT superfamily protein [Cucurbita moschata (Rifu)] | MFLILFSAYIASSFVNRLRTFNSVYMATPHFLLPFMAQGHMIPMVDLAKLLAHRGAIVTIVLT PNNAARNHSVLSRAIDSGLQIRVVQLEFPWKEGGLPEGCNVDLLPSLTSMSTFFKAASLLYDP SEKLFLQLHPRPASIISDMNLPWTLQLAQKFHVPRLVFYSYSAYFLHCLQGLMTHRDPVEFHKS ELPRATDADLAKFGVEMMLADAQSYGVVFNSFEEMEPKVAECRKTRESPEKVWCVGPVSLCNN DKLDKAERGNKASIDQHQCIEWLDGQQPTSVVYVSLGSICNLVTAQLIELGLGLEASNKPFIWV IRKANLTEELLKWLEYDLEGKTKGRSLVIRGWAPQVLLISHPSIGCFLTHCGWNSSIEGISAG VPMITWPLFADQVFNYKLIVEVLKVGVGMGVETVMHWGEEEEIGVVVKREKVREAIEMVPDGED REEMRQRSKKLAVMAKRAVEEGGSSHRDIKLLIEDTVAHGGDHEI | 1109 | CmoCh14G002330.1 |
| UGT superfamily protein [Cucurbita pepo (Zuchinni) pepo (Zuchinni)] | MGSETNSGEYHILMLPFMAHGHLIPPLELANFIHRKSSVFTITIACTPSNIQYLRSAADSKIR LAELYYSSSDHGLPPNTESTENLPLNQIDTLFHSSTALELPLRELISDLVQKEGNPPQCIISDV FLGWSVAVARSFNIPVFSFTTCGAYGTLAYISLWMNLPHRSSTSDEFSLPGFPESCRFHRSQLH RFLLAADGTDSWSRYFRPQISYSLSSDGWLCNTVEEVESFGLKHLRDYIKLPVWAIGPLLLQTS SGGRRRWGKEKDSGVGLEACMWLNSHRKNSVLYISFGSQNTITETQMMELAYGLEESGSAFIW VVRPPSGHDMKAEFRAHQWLPEHFEDRMKETNRGLVIRNWAPQLEIHAHESVGAFLSHCCWNST VESLSQGVPVIGWPMAAEQAYNSKMLVEEMGIGVELTRGKESEIKRGRVKEVIEMVMGERCEGGE EMRNKAAIVKDKMRAAVMDEQKGSSNTNLVDFLEPIQAKQKSLNKIK | 1110 | Cp4.1LG08g05750.1 |
| UGT superfamily protein [Cucumis melo (Melon)] | MDSHTHGTPHFLLLFPFMAQGHMIPMIDLAKLLACRGAIITIVITPLNSARFHSVLTRAIDSGHQ IHVHELQFPSHQETGLPEGCENVDLLPSLSLASLSQFYQAISLLHQPSEKLFEQLTPRPNCIISDM CIPWTFEISQKFHVPRLVFYSLSCFFLLCMRSLITTNFEFIKSMPDSEFLTLPGLPSHVKFRRSK IFTSTDDYLIQFSLRMWEADRQSYGVIVNVFEEMEPEHVTEYIKGRESPEKVWCVGPLSLSNDN ELDKAERGNKAIIDGHECIKWMDEQKPSSVVYVSLGSLCNLCTEQIKELGLGLEASNKPFIWVI RKANLTEELLKWMDEYEFEKTKGRGLVIKVGVSVGGEETEGDLGGGVGKVVVKREKVKEAIEMVMDGDDSEE PMITWPLFADQLYNHKFIVEILKVGVSVGGEETEGDLGGGVGKVVVKREKVKEAIEMVMDGDDSEE MRKRCKEYSEKAKKAVEEGGSSHRNLNRLVEDITAHAFAYGNENGNGSC | 1111 | MELO3C009389P1 |

TABLE 1-continued

Some protein and DNA sequences disclosed herein

| Protein/DNA Description | Protein/DNA Sequence | SEQ ID NO | Accessio No./Reference |
|---|---|---|---|
| UGT superfamily protein [Cucumis melo (Melon)] | MASTPHFLLFPFMEQGHMIPMIDLAKLLALHGAIITIFTTPINAARYHSVLSRAIHSGSQIHVV QVPPPGNKVGLPEGCESAELLPSRSMFTFFRATYLLYDPADELLQQLRPRPTAIISDCCHPWT LRLAHKHNIPRLVFYSLNCPFFLCQQDLGTKETLLRSISDYEFVTLVEEFKFRKAQLPKFNDDF VAFMKESNEADMMSDGVILNVFEELEPKYNAEYKKIFGSPDRVWCVGPLSLCNESKLDRAERGD KASIDEHECTKWLDEQEPCSVVYVSLGSACNLVTAQHIELGLGLEALNKPFIWVIRKGNLTEEL LKWLEEYDFBEKIKGRGFLIRGWAPQVLLSHSSIGSFLTHCGWNSSIEGIAAGVPMITWPLFG DQIYNQTLIVEILKIGASVGVEMGMPWGEEEEKGVVVKREKVKEAIEMVMEGENRAEMKQRCKE LAEMAKRAVEEGGSSHRNLRLLIQKHQQL | 1112 | MELO3C009387P1 |
| UGT superfamily protein [Citrullus lanatus (Watermelon)] | MAQGHMIPMIDLAKLLAHHGSIITIVTTPHNAARYHSVLARATDSGLQIHMVLLQFPSTQVGLP EGCENLDLLPSLSSVAAFYRATCLLYEPSEKLLFHQLSPPPTCIISDMCLPWTLRLAQNHQIP RLVFYSLSSFFLLCMRSLKINHDLVTSISDSEFLTLSDLPDPVEFRKSQLPTVKIQEMEKLGYE MVEADRQSHGVILNVFEEMEAEVYAEYRKNRESPEKVWCVGPVSLCNDNTLDKAERGEKSSING DKCIKWLDEQOPCSVVYVSMGSLCNLRTPQLIELGLGLEASKKPFIWVIRKGNLTEDLQRWVVE YDFEGKIEGRGLVIRGWAPQVAILSHSAGSFLTHCGWNSSIEGISAGVPMITWPLFADQVFNA KLIVEVLKVGVSVGETALYWGGBEENGVMVKREEVRRAIEMVMDGEDREEMRQRSKEPAEMAK RAVEEGGSSHRNLKLLIEEIMYENGSCR | 1113 | Cla017773 |
| UGT 73C1-like [Citrus sinensis] | MDTQANQLHFVLFPLAQGHMIPMIDIARLLAQRGVIITIVTTPVNAARPNGILARAIESGLQI KIVQFQLPCEEAGLPEGCENLDMVASLGLAFDFFTAADMLQEPVENFFAQLKPRPNCIISDMCL PYTAHIAGKFNIPRITFHGTCCFLVCYNNLFTSKVFESVSSESEYFVVPCLPDKIEFTTQQVD SSLGSRFNVFQKKMGAADTGTYGVIVNSPEELEPAYIKEYKKIRHDKVWCIGPVSLGNKEYSDK AQRGNKASVDEHQCLKWLDSKAPKSVVYACLGSLCNLIPSQMRELGLGLEASNRPFIWVIREGE TSKELKKWVVEDGFERIKGRGLVIWGWAPQVLLISHPSIGGFLTHCGWNSTIEGVSAGLPLLT WPLFGDQFMNEKLVVQILKIGVKVGVESPMIWGEEQKNGVLMKRDDVRNAVEKLMDEGKEGEER RNRAVKLGQMANMAVQEGGSSHLNITLVIQDIMKHVHSTSQANK | 1114 | XP_006492619 |
| UGT 73C6-like [Momordica charantia (bitter melon)] | MASPHFLIFPMAQGHMIPMMDLANLLAHQGAIVTIVTTPHNAARYHSVLTRAIGSGSQIRVVQ LEFPCHEAGLPHGCENLDLLPSLSSMSTFMKATYLLHDPSEKLLPQLSPRPTCIISDMCLPWTL TLAHKFRVPRLVLYSLCFLLCMHSVKYHIPSFSSISDSELVDFSGLPHPVQFRKSQLPKATD EAMSKFGYEMGEADRQSHGVIINTPEEMEPEYLAEYRKLRELPEKVWCVGPLLYNDMKLDVAQ RGNTAAIDENECINWLDGQRPCSVVYVSLGSLCNLTTPQLIELGLGLEASNKPFIWVIRKLNLT KELLDWMEEYDFEGRTKXRGLVIRGWAPQVMILSHSSTGCFLTHCGWNSSIEGMSAGVPMITWP LFADQVFNEKLLVEIVRIGVSVGAETAVPWGEEERKIGVLVKRESVREAIEMAMDGDGSEMRQR CKQLAEKAKRAVQEGGSSHRNLKLLIEEIVDDGRSCENGSC | 1115 | XP_022144752 |
| UGT superfamily protein [Cucurbita pepo subsp. Pepo (vegetable marrow)] | MAPHSDTLHFLLFPMAQGHMIPMMDLAKLLARNGAIVTIVTTPLNFARYHSVLTRAIDSGLQI HVVQLQFPWTKNSGIPEGCENVDLLPSLSYLSHFYRVLSLLYDPSEKLFEQLTPRPNCIISDMC IPWTFQLAQKFHVPRLVFYSLSCFFLLCLNRLFGKSDVWKSLSDSEFVAVPDFPDPVEFLKSHL PRGITDDYATQFGQAMKEADRQSYGVILNVFEEMEPEYLTEYKKGRELPENVWCVGPLSLSNDNE LDKABRGNKASINEHECIKWLNGQOPSSVVHASLGSLCNIGTEQLIELGLGLEASKPFIWVIR KANLKEELLKWLEEYDFERKVSGRGLVIRGWAPQVLILSHSAIGCFLTHCGWNSSIEGISAGVP MITWPLFADQIFNEKLIVQILKVGVSVGEETVVHPDREDEELVLVKREKVREAIETVMDGDERE AMRERSKKLANKAKTAMEEGGSSHRNLKMLIQDLIAHGRSSKNGSC | 1116 | XP_023540660 |
| UGT super family protein [Cucurbita pepo (Zucchini)] | MTDSQOEAPCHVFLVCYPGQGHINPTLRLAKKLAAEGLLVTISTAVHFGKTLQKAGSIGAGDCPT PVGNGFIRFBFFEDGLQELNPKDVNLERVVYQIELFGRPSLAGLIKNQTAENRSVSCLIVNPFL PWTCEVAKELEIPCAILWQSCAVFSIYYHCYHKSVPFPSELEPKIDVHLPILPLLKNDEIPSF LHPNNIYGVLGNVLLSQFSKLSTPFCILMDTFDELEKDIINYMSNIIPLKPIGPLFLNSQNVET | 1117 | Cp4.1LG04g07810.1 |

TABLE 1-continued

Some protein and DNA sequences disclosed herein

| Protein/DNA Description | Protein/DNA Sequence | SEQ ID NO | Accessio No./Reference |
|---|---|---|---|
| UGT super family protein [Cucurbita pepo (Zucchini)] | EVSVDCLKAEDCMEWLNSKPTQSVVYVSFGSIVHLKQEQINELAYGLCNSGFSFLWVMKPPDDV YGLKGHVLPEGVMEKAGERGKVVQWSSQERVLSHESVGCFMTHCGWNSSVEAICGCVPVVAFPQ WGDQVTNAKPLVEDYGVGVRLSRGAEANELISRDEIVRCISEVMTRDSSGEFRRNALKLKQAA AAAVVDGGSSHHNIQEFVDEIKKRRMNMCSECS | 1118 | Cp4.1LG06g05470.1 |
| UGT super family protein [Cucumis sativus (Cucumber (Chinese Long))] | MKHVSNKPRVLFVPYPAQGHVTPMLMLAAVFQRRGFLPLPLTPSYIHRHISSQISLINEILFIS MPDTVDDNTPHDFFTIETALETTMPSYVRRVLGEYNSNESGVCMVVDLLASSAIEVGKEYGVA VAGEWPAMFATYNLISAVPDMVKNNLISSDTGCPGEGSKRCVPNQPLLSTEELPWLIGTSSARK ARFKFWTRIMVRAKSLQWLIVNSFPEELPLENPIPKSSAAVFLVGPLSRHSNPAKTPTFWEEDD GCLQWLEKQSPNSVVYISFGSWVSPINESKVRSLAVALLGLRKPPIWVLKSNWRDGLPIGFTQK IQRYGRLVSWAPQMEILKHRAVGCYLTHCGWNSIMEAIQCRKRLLCFPVAGDQFLNCGYVVKVW RIGLKLNGFGEKEVEEGVRKVMEDGEMKARMMKLHERIMGEDANSRVNSSFTTFIKDINKLSFD KFL | 1119 | Csa5G196560.1 |
| UGT super family protein [Lagenaria siceraria (Bottle gourd)] | MKGEPQAPHVLIFPLPFQGHINSMLKLAELLSIAGITVTFLNTPHFQSQLTRHSDVLSRFSRFP TFRFHTIIDGLPPDHPRTIEFFAQIISSLLDSITKPIFRNWLVSGHFGSNLTCVVLDGFLKNFID GDEDEVKQPIFGFRTVSACSVWTYLCAPHLIEDGQLPIRGEEDMDRMITNLPGMENLLRCRDLP GLCRVTDTNDSVLQYTLKQTQGSYQFHALILNSFEDLEGPILSKIRTNLCPNLYTIGPLHSLLK TKLSHETESLNNLWEVDRTCLAWLDNQPPGSVIVSFGSITVMGNEGLMEFWHGLVNSGRNFLW VIRPDLIVSGKNGEIEIPADLEEGTKQRGYVVGWAPQEKVLSHEAVGGFLTHSGWNSTLESIVAG KAMVCWPYTADQQVNSRFVSNVWKLGVDMKDMCDREIVAKMVNEVMVNRKEEFKRSAIEMANLA RRSVSLGGSSYADFDRLVNEIRLLSLRQ | 1120 | Lsi01G014910.1 |
| UGT super family protein [Cucumis melo (Melon)] | MAKPRVLLFPFPALGHVKPPLSLAELLSDAGLDVVFLNSEYNHRRISNVIESLSSRFPSLRFET IPDGLPPDQPRSLVDSPLYFTMRDSTKARFRRQLIQSFNDGCSANPWPITCIINDVMLSSPIEVA EEFGIPVISFCPHSARYFYTHFLVPKLVEBGQIPYTDENPFGKIEGIPLFEGHLRRNHLPGSWS QQSSHISFSHSLINQTVAAARSSALILNTFHDLEAPFLTHLSSIFNRIYTIGPLHALFKSKLSN SSSLPPTLVGFQKEDESCIWLDSQPPESVIFVSFGSSMMEAERLTEFWHGLVNSGFRFLCVL RSDGVYGGESAELIEBQVVGKKGYDRNVVVEWADQEKVLSHPAIGGFLTHCGWNSTLESIVAGV PMIGWPILGDQPSNAAWIDKVWKIGIERNDEKNWDRSTVKMMVRELMDSQKGVEIRRSVKKLSK LTKENVGKGGLSFDNLEYLVQHIKNLKPYI | 1121 | MELO3C018664.2.1 |
| UGT super family protein [Citrullus lanatus, Watermelon (Charleston Gray)] | MGSLSKVDQENQQPHAVFVPYPSQCHISPMLKLAKLFHHKGFHVTFVNTEYNHRRLLLRSRGPNS LDGLPDFQFRAIPDGLPPSDGNATQHVPSLCYSTSRNCLAPLCSLISEINSSGSTVPPVSCIIG DGVMTFTVFAAQKFGIPIASFWTASACGLGYMQYAKLVEQQMIPFKDENFMSNGDLEETIEWI PPMEKIRLRDIPSFIRTTDKDDIMLNFFIQQLETLPKANAIINTFDSLEHHVLEALSSKLPPI YPIGPINSLVTELIKDDKVKGIRSNLWDEQSECMKWLDSQQPNSVVYVNFGSITVMSPQHLVEF AWGLANSEKPFLWIVRPDLVEGETALLPAEFVAETKERGMLGDWCNQEEVLKHPSVGGFLTHSG WNSTMESIAGGVAMISWPPFAEQQTNCRYCKTEWGNGLEIDSNVRREDVEKLVRELMEGEKGED MKRNAKEWKRKAEEACKIGGSSLINLDQVISEILLSKDKSNLKSQN | 1122 | C1CG04G007490.1 |
| UGT super family protein [Citrullus lanatus, Watermelon (Charleston Gray)] | MDSHTRTHHHVLLFPFPANGHIKPFLCLAHLLCNAGLRVTFLNTHHHHRNITHNLTRLAAQFPS LHFESISDGLPLDQPRNIVDGKLFESMPPRVTKHLLFRQLLLSYNNGTSPITCVITDVILRFPMDV AQELRIPVFCFATFNARFLFLFFSIPKLIEDGQIPYPVGNSNQLFEHGVPGGEGLLRCKDLPGFW SVEDVAKMDPMNFVSQILATSKSSGLILNTFDELEAPFVVSLSKIYKRLYTIGPIHSLLKNSTQ SQCEFWKEDHSCLAWLDSQPPRSVLFVSFGSLVKLTSSQLKEFWNGLVNSGKAFVLVLRSDGLI EEAGEBDGKQKKLVIKEIMDTKAEGRWMIVNWAPQEQVLVHEAIGGFLTHSGWNSTLESLTAGVP MISWPQIGDQTSNATWITKVWKIGVQMEGSYDRSTVETMVKSIMEQQDEKMENTIAELAKRAKD RVSKHGTSYQNLQRLVEDIQEIKLN | 1122 | C1CG04G007490.1 |

TABLE 1-continued

Some protein and DNA sequences disclosed herein

| Protein/DNA Description | Protein/DNA Sequence | SEQ ID NO | Accessio No./Reference |
|---|---|---|---|
| hypothetical protein CISIN_1g011792mg [Citrus sinensis] | MEQTRVPHVLLPPPAYGHIKPMLSLAKLFSHAGRRITFVNTDQYHDRLFGNTDVTAFYKHFPN FLCTSIPDGLPPDNPRFGIYTKDWFCSNKPVSKLAFRQLLMTPGRLPTCISDSIMSFAIDVAE ELNIPIITFRPYSAYCSWSDFHFSKLAEEGELPVTDENFPDKPVTCIPELENIFRNRDLPSICRH GGPDDPILQTFIRDTSATTRTSALVINTFNEIEGPIISKLGSRLTKIYTVGPLHALLKSRIQED SVESSPLESNNCVLSKEDRSCMTWLGSQPSRSVLYVSFGSFIKLSGDQILEFWHGIVNSGKGFL WVIRSDLIDGESGVGPVPAELDQGTKERGCIVSWAPQEEVLAHQAIGGFLTHSGWNSTLESMVA GVPMICWPQVGDQQVNSRCVSEIWKIGFDMKDTCDRSTIEKLVRDLMDNKRDKIMESTVQIAKM ARDAVKEGGSSYRNLEKLIEDIRLMAFKA | 1123 | KD043669.1 |
| 7-deoxyloganetic acid glucosyltransferase-like [Momordica charantia] | MAQPTQARVLVFPYPTVGHIKPFLSLAELLADGGLDVVFLSTEYNHRRIPNLEALASRFPTLH FDTIPDGLPIDKPRVIIGGELYTSMRDGVKQRLRQVLQSYNDGSSPITCVICDVMLSGPIEAAE ELGIPVTFCPYSARYLCAHFVMPKLIEEGQIPFTDGNLAGEIQGVPLFGGLLRRDHLPGFWFV KSLSDEVWSHAFLNQTLAVGRISALIINTIDELEAPFLAHLSSTEDKIYPIGPLDALSKSRLGD SSSSTVLTAFWKEDQACMSWLDSQPPKSVIFVSFGSTMRMTADKLVEFWHGLVNSGTRFLCVL RSDIVEGGGAADLIKQVGETGNGIVVEWAAQEKVLAHRAVGGFLTHCGWNSTMESIAAGVPMMC WQIYGDQMINATWIGKVWKIGIERDDKWDRSTVEKMIKELMEGEKGAERIQRSMEKFSKLANDKV VKGGTSFENLELIVEYLKKLKPSN | 1124 | XP_022151474.1 |
| 7-deoxyloganetic acid glucosyltransferase-like [Momordica charantia] | MAQPRVLLFPPAMGHVKPFLSLAELLSDAGVEVVFLSTEYNHRRIPDIGALAARFPTLHFETI PDGLPPDQPRVLADGHLYFSMLDGTKPRFRQLIQSLNGNPRPITCIINDVMLSSPIEVAEEFGI PVIAFCPCSARFLSVHFFMPNFIEEAQIPYTDENPMGKIEEATVFEGLLRRKDLPGLWCAKSSN ISFSHRFINQTIAAGRASALILNTFDELESPFLNHLSSIFPKIYCIGPLNALSRSRLGKSSSSS SALAGFWKEDQAYMSWLESQPPRSVIFVSFGSTMKMEAWKLAEFWYGLVNSGGPFLFVFRPDCV INSGDAAEVMEGRGRGMVVEWASQEKVLAHPAVGGFLTHCGWNSTVESIVAGVPMMCCPIVADQ LSNATWIHKVWKIGIEGDEKWDRSTVEMMIKELMESQKGTEIRTSIEMLSKLANEKVVKGGTSL NNFELLVEDIKTLRRPYT | 1125 | XP_022151546.1 |
| 7-deoxyloganetic acid glucosyltransferase-like [Cucurbita maxima] | MELSHTHHVLLFPPPAKGHIKPFFSLAQLLCNAGLRVTFLNTDHHHRRIHDLNRLAAQLPTLHF DSVSDGLPPDEPRNVFDGKLYESIRQVTSSLFRELLVSYNNGTSSGRPPITCVITDVMFRFPID IAEELGIPVFTFSTPSARFLFLIFWIPKLLEDGQLRYPBQELHGVPGAEGLIRWKDLPGFWSVE DVADMDPMNFVNQTLATSRSSGLLINTFDELEAPLTSLSKIYKKIYSLGPINSLLKNFQSQPQ YNLWKEDHSCMAWLDSQPRKSVVFVSFGSVVKLTSRQLMEFWNGLVNSGMPFLLVLRSDVIEAG EEVVREIMERKAEGRWVIVSWAPQEEVLAHDAVGGFLTHSGWNSTLESLAAGVPMISWPQIGDQ TSNSTWISKVWRIGLQLEDGFDSSTIETMVRSIMDQTMEKTVAELAERAKNRASKNGTSYRNFQ TLIQDITNIIETHI | 1126 | XP_022978164.1 |
| 7-deoxyloganetic acid glucosyltransferase-like [Rosa chinensis] | MEMQMELRPQHVLLLFPPAQGHIKPMLALAQLLCHAGIHVTFLNTEHNHRQLTQRQALSARFP TLHFRSISDGLPSDHPRSISPNLMDIVSSLRSKTAPLLHQLLVSIMSKNDVGSAAQLPSLGCVI TDGIMCFAIEAAEEVGIPVIALRTTSACSFWCYSCIPKLIEEAQLPFGDEDMDKMVSGIPGMEC LLRRRDLPSICRVPTDHPVIQFFVEETRAITRASSLILNTFDDLESSILSHIASRFSKIYTIGP LHALLKSRVVDDNLSSSLRQEDRGCMMWLDSQRVGSVIFVSFGSLVKLTRVQLLEFWHGLVNSG SPFLWVIRSDVLMSDEAEQASHVTPAEVIVDWAPQEEVLAHEAVGGFLTHSGWNSTLEAIWAGV PMLCWPQLADQQVNSRWVGEVWKIGVDMKDTCDRSTVEKMIKALMKGEDKEVISRSVDHFAKLA RTSVSKNGSSYLNLEKLIQDLRNL | 1127 | XP_024189663.1 |
| UGT super family protein [Lagenaria siceraria (Bottle | MDLSHSQTHHVLLFPPVKGHIKPFLCLAHLLCNAGLQVTFLNTHHHRNIHNLTHLAAQFPS LHFQSISDGLLPDQPRNTVDGKLLESMPRVTKTLFRQLLLSYSNGTSPITCVITDVILHFSMDV AQELGIPVFCFSTFSACSLCLLFSIPKLLEDGQVPYPVENSNQELHGIGGEGIFRCKDLPGPW | 1128 | Lsi01G015000.1 |

TABLE 1-continued

Some protein and DNA sequences disclosed herein

| Protein/DNA Description | Protein/DNA Sequence | SEQ ID NO | Accessio No./Reference |
|---|---|---|---|
| gourd)] | SVEDVVKNDPMKFVNQILATSKSCGIILNTFDELEALFVTCLSKIYNKVYTIGPIHSLLKNSTQ<br>TQYEFWKEDHSCLKWLDSQPPRSVVFVSFGSLVLKLTSSQLKEFWNGLVNSGKAFMLVLRSDVLI<br>EEAGEEEKQKELVLREIMDTEGEGRWVIVNWAPQEEVLGHEAIGGFLTHSGWNSTLESLTAGV<br>PMICWPQIEDQTCNATWIITKVWKIGVEMEDSYDRSTVETMVRSIMEHQDEKMENNIAELAKRAK<br>DHVSKHGTSYQNLQRLVEDIKEIKLN | | |
| Flavonoid UDP-glucosyltransferase 3 [Lagenaria siceraria (Bottle gourd)] | MEEQTSSPHVLLFPAPAQGHINVMLKLAELLSLSAIHVTFLTTEHSHRQLTLHSDVLHRFSRF<br>PAFQRRTISDGLPFSHPRTFSHHLPEIVNSLISVTKPLFRDLLISGHYASDLTCLILDGFFSFL<br>VDIDDDFVKLPIFCRRTFGACSSWAILSVPNLIKQGQLPIEGEEDMDRRILDNVPAMENLLRCRD<br>LPGFCRAADPNNDPILQFIVSMFIRCTKFDALIMNTFEDLEGPILSNIRTLCPKIYSIGPLHAL<br>LKTKLSHETRSLNNLWEVDRSCLAWLDKPPGSVIYVSFGSITVMGNRELMEFWHGLVNSGRNF<br>LWAIRPDLMKGKDGEIEIPAELEEGTKQRGYMVGWVPQEKVLSHKAVGGFLTHSGWNSTLESII<br>EGKPMICWPYAFDQQVNSRFVSNVWKLGLDMKDLCDRETVAKMVNDVMNRKDEFMRSAAEIGN<br>LARRSVNPGGSSYVNFDCLIEDIRILSQQKMANNN | 1129 | Lsi04G009410.1 |
| UDP-glucuronosyl/UDP-glucosyltransferase [Cucumis sativus (Cucumber (Chinese Long))] | MGLSPTDHVLLFPPAKGHIKPFFCLAHLLCNAGLRVTFLSTEHHHQKLHNLTHLAAQIPSLHF<br>QSISDGLSLDHPRNLLDGQLFKSMPQVTKPLFRQLLSYKDGTSPITCVITDLLLRFPMDVAQE<br>LDIPVFCFSTFSARLFLYFSIPKLLEDGQIPYPBGNSNQVLHGIPGAEGLLRCKDLPGYWSVE<br>AVANYNPMNFVNQTIATSKSHGLLINTFDELEVPFITNLSKIYKKVYTIGPIHSLLKKSVQTQY<br>EFWKEDHSCLAWLDSQPPRSVMFVSFGSIVKLKSSQLKEFWNGLVDSGKAFLLVLRSDAIVEET<br>GEEDEKQKELVIKEIMETKEEGRMVIVNWAPQEKVLEHKAIGGFLTHSGWNSTLESVAVGVPMV<br>SWPQIGDQPSNATWLSKVWKIGVEMEDSYDRSTVESKVRSIMEHEDKKMENAIVELAKRVDDRV<br>SKEGTSYQNLQRLIEDIEGFKLN | 1130 | Csa4G303180.1 |
| UGT super family protein [Cucurbita maxima (Rimu)] | MEQRGDVPHVLIFPPPAAQGHVNSMLKLAELLSLSGLRITFLNINIHRIHQKLTLHSDILSRFSRFP<br>NFQFRTITDGLTPQNRTLGMFSDLIRRLNSVTKPLLTQMLLSGELGPNPTCIILDGLFNFIVDV<br>DAQPKIPVFSFRTISACSFWAYSFVPMLIEDGQLPIKGEEDMDRMIDGVTGMENVLRCRDLPSF<br>CRLKDPSDPTLQHGVTQTIQSLKAHSLIFNTFEDELEGPILSGLRRRCPNIYAIGPLHSLLKSRL<br>SGEESPFGSESFNNLWEVDRSCLAWLDAQPSKSVIYVSFGSVVVMGDGQPREFWHGLVNSGRRF<br>LWVVRPNSVAGEDGENGIIEELEKGTKERGCMVEWAPQEEVLAHEAIGGFLTHCGWNSTLESIV<br>AGVPMICWPQFADQQTNSRYVSEVWRIGVDMKDVCDRETVSQMVNDVMENRRNELMGSVIETAK<br>LAKTSVEEGGSSFRDLERMINDIRLLCRQREAIH | 1131 | CmaCh04G011530.1 |
| UGT super family protein [Cucurbita moschata (Rifu)] | MELSRTHHVLLFPPPAKGHIKPFFSLAQLLCNAGLHVTFLNTDHHHRRIHDLNRLAAQLPTLHF<br>DSVSDGLPPDEPRDVPDRKLCESIRQVTSSLFRELLVSYNNGTSSGRPPITCVITDVMFRFPID<br>IAEELGIPVFTFSTRSARFLFLFIWIPKLLEDGQLRYPEQELHGVPGAEGLIRWKDLPGFWSVE<br>DVADWDPMNFVNQTLATSRSSGLLINTFDELEAPPLISLSKIYKKIYSLGPINSLLKNIQSQPQ<br>YNLWKEDHSCMAWLDSQPRKSVVFVSFGSVVKLTNRQLVEFWNGLVNSGKPFLLVLRSDVIEAG<br>EEVVRENMERKAEGRWMIVSWAPQOEEVLAHDAVGGFLTHSGMNSTLESLAAGVPMISWPQIGDQ<br>TSNSTWVSKVWRIGLQLEDGFDSSTIETMVRSVMDQTMEKTVAELAERAKNRASKNGTSYRNFQ<br>TLIQDITNIIETHI | 1132 | CmoCh03G004020.1 |
| Glycosyltransferase [Cucurbita pepo (Zucchini)] | MELSHTHHVLLFPPPAKGHIKPFFSLAQLLCNAGLRVTFLNTDHHHRRIHDLNRLAAQLPTLHF<br>DSVSDGLPPDEPRDVPDRKLCDSIRQVTSSLFRELLVSYNNGSSSGRPPITCVITDVMFRFPID<br>IAEELGIPVFTFSTFSARFLFLFIWIPKLLEHGQLQYPVTSSLFRDLLVSYNNGTSSGRPPITC<br>VITDCMFRFPIDIAEELGIPVFTFSTFSARFLFFWIPKLLEDGQLRYPEQELHGVPGAEGLI<br>RCKDLPGFLSDEDVAHWKPMNFVNQILATSRSSGLLINTFDELEAPFLISLSKIYKKIYIHSLH<br>INQTPPPTGDQLHSISSPGDFNRFYRRLLLRHLRNGDSQNPILHRRLDLLHFSILRQSEPQEL | 1133 | Cp4.1LG10g08310.1 |

TABLE 1-continued

Some protein and DNA sequences disclosed herein

| Protein/DNA Description | Protein/DNA Sequence | SEQ ID NO | Accessio No./Reference |
|---|---|---|---|
| UGT [Cucurbita pepo (Zucchini)] | PFAPPNAMPLLVLLLLFNASLSADLKHAAVLHLHFDLLLQPRQIGLENVGLWGLFPIDLRASL AVVGAHMSDKKGSKRLLVPNTLGIKDILVFFILPLPSPTFFPCMAMASNTASSRSFSRLPSQWR QPSPGLEFGLSAPAQ | 1134 | Cp4.1LG10g11120.1 |
| Glysosyltransferase [Cucumis melo (Melon)] | MERKQKERKGHLVLVPCPLPSHMSPMLHLAKLLHSQGFSITIIHTQLNSPNESHYPEFSFESIG GSMLESYSVFDGDVMLFLSKLNMKCETPFHECLVNMQLRCQFNPISCIIYDAVMYFSAAVADDL KLFRIVLRISSAANYIGLSILDESDFVSERRMEEPVAGPFLRIKDMPLFSTQKHTREVLICIY NGTRTASAIIWNSLWCLEHALFEKIKNETIVPVFPLGPLQKHCSSFSTNALNEEQGCIAWLDKQ APSSVVYVSIGSVVTMTEDELLEMAWGLANSGRPFLWVVRACVVNGSDGVEMLPREFHEATRSR CRIASWLPQQKVLAHTSIGCFLTHNGWNSTIESIAEGVPMLCWPRVGDQRVNARFVSHVWRVGL QLEDRLLREDVESAIRTLFIDEEGIEHKRAKELKKKVDISLRQGGASSEFLSRLVKYISLRRD NDKVVKCLLISL | 1135 | MELO3C003567.2.1 |
| UGT 1 [Citrullus lanatus, Watermelon (Charleston Gray)] | MGSISISEQQPHAVCIPYPAQGHINPMLKIAKLLHSPGFHITFVNTDFNHRRLLKSRGPKALDG LSSFRFESIPDGLPPTDVDATQDIPSLCQSTRQFCLPPKELVSKLNCDPNVPQVSCIVSDGVM SFTIDAADELGVPVVLFWTTSACGFLGYLHYQQLVERGYTPFKDESYLSNKQYLDTKIDWIPGM KDVRIRDIPTFIRTTDPKDVMVDFILGETKRAKRANAIVLNTVDSLEQEALNAMPSLLPPPVFS IGPLQLLLKQVASHDSDSLKSLGSNLWKEDTSCLQWLDQMSANSVVYVNFGSITVMTKDQLKEF AWGLANSGQTFLWIIRPDLVAGDTAVLPPEFIDMTKERGMLTNWCPQEEVLQHPAIGGFLTHNG WNSTPESIVAGVPMICWPFFAEQQTNCRYCCTEWGIGMEIDSDVKREEIEKQVRELMEGDKGKE MRKRAQEWKKLMADAAEPHSGSSFRNLMHLVHKVLLQSP* | 1136 | C1CG07G003780.1 |
| 7-deoxyloganetic acid glucosyltransferase-like [Momordica charantia (bitter melon)] | MEKGVEPHVLMFPFPALGHVNPMLKLAELLSLSGLRITFLNIHSIHQRLILHTNLQSRFSCFPK FRFQTITDGLPPSYTGGLTKLSHLVRSMETVTKPLLKQMLLSGELGPIPTCIILDGFFSFMVDS TLSLEFPFSVSAPACSFWAYFSIPELIQEGQLPVKGEEDMDRMIEGVAGLENILRCRDLPSFSR VGDQTEPIIQYSVAQTIESSKAHALILNTFEDLEGPILSCIRRRCPNIYAIGPLHAHLKSRHPG EKSPPELESSNGNWEVDRSCLAWLDAQPSKSVVYVSFGSVTVMGDNQFREFWHGLVDSGRRFLW VVRPNMVSGKDGENGVPAELEEGTKERGCMVGWAPQEEVLAHEAIGGFLTHSGWNSTLEGIVAG VPMICWPQFADQLINSRFVSEVWKIGLDMKDVCDRKTVAKMVNDVMENRRNELMGSVIETAKLA ISSVEEGGSSYCDLKRMIHDIQLLCRRRGEAID | 1137 | XP_022151514 |
| 7-deoxyloganetic acid glucosyltransferase-like [Quercus suber] | MEQSDSNSDHQHVLLFPPAKGHIKPFLCLAQLLCGAGLQVTFLNTDHNHRIDDRHRRLLA TQFPMLHFKSISDGLPPDHPRDLLDGKLIASMRRVTESLFRQLLLSYNGYGNGTNNVSNSGRRP PISCVITDVIFSFPVEVAEELGIPVFSFATFSARPLFLYFWIPKLIQEGQLPFPDGKTNQELYG VPGAEGIIRCKDLPGSWSVEAVAKNDPMNFVKQTLASSRKSSGLLINTFEDLEAPFVTHLSNTFD KIYTIGPIHSLLGTSHCGLMKEDYACLAWLDARPRKSVVFVSFGSLVKTTSRELMELMHGLVSS GKSFLIVLRSDVVEGEDEEQVVKEILESNGEBGKMLVVGWAPQEEVLAHEAIGGFLTHSGWNSTM ESIRAAGVPMVCWPKIGDQPSNCTWVSRVNKVGLEMEERYDRSTVARMARSMMEQGKEMERRIA ELAKRVKYRVGKDGBSYRNLESLIRDIKITKSSN | 1138 | XP_023913036 |
| | MEQHKVPHVVILPLPLSGHVKPMLILAELLCDAGFLITFVNSDYNHDRLERVMDIPAFYNRSPG FRFVSIDGLPLDQPRLGPIIFQLFENTRTVSKPLFRELLISLRQSTERSPPTCIIADGLMCFA IDVAEELGVPIITFPTHGYHGMWTIMHTSNLIEEGEVPQEESDMDKPVTSIPGMESLLRRRDL PGNCRLEVENPLMEFIISEASAMKRASTLILNTFEELEAPIIAHLGSFPDKVYTIGPLHALLKT RIKDSSQAVSSYGSLRKEDSSCVEWLNSQPLKSVIYVSFGSVVELSLDQLIELWHGLVNSRKPF LWVVRPDLVEGNEELGQISEELEQGTKEKGCMVSWAPQEEVLAHPSVGGFLTHSGWNSTLESIF EGVPMICWPQVADQQVNGRSVSKLWRVGFDMKDTCDRFIIEKIVRDLMEDKREELIRSTNEIAR MARGSVKENGSSHCNLERLIEDLRLMSLIN | | |

TABLE 1-continued

Some protein and DNA sequences disclosed herein

| Protein/DNA Description | Protein/DNA Sequence | SEQ ID NO | Accessio No./Reference |
|---|---|---|---|
| UGT protein (Citrullus lanatus, Watermelon) | MDAQESFKVFMLPWLAHGHISPYLELAKRLAKRKFIVYFCSTPVNLEAIKSNVLSKSYSDSIQ LVKIHLQSTPELPHYHTAKGLPHLMPKLKDAFQMAAPNLESILKTLNPDLLIVDIQLWMLP ISSSLNIPMIFFPIPGAIITSFLIRIVSNDVRFPEFELRDYWQSKCPYLQMDETSRQTFKQNLD QSSGIILFKSSREIETKYLEFLASSFTNKIVTTGPLLQEPACSEKEKHYEIIEWLDKKELYSTV LVSFGSEYYLSKEEIEEIAHGLEISEANFIWIVRFPNGDETAVEAAVPEGFIERSRERGKIVKG WAPQTEILAHRSTGGHMSHCGWSSFMESLMYGWPVIGAPMQLDGPIVARLAEEIGVGLEIKRDE EGRMRDEIAGAIKVLMEKPGEVRPRKKAKEISSVLKEKDDEELDRLTTELVRLCETKRT | 1139 | Cla020504 |
| UGT (Citrullus lanatus, Watermelon) | MEGSESRKKVLLFPWLAFGHISPFLELAKKLSQNNFQIYLCSSPINLQSIHSKLPQSFCSSINL VELNLPSLPQLPPMHSTNGLPLDLIPTLFKAFEMAAPEFSSIILHRLNPDLLITDSFQPWAIQS ASSLNIPVIPFSVVGAAVLAHSIHYIINPNIKFPFPEIDLMDHWISKRHPDIFKNPDVSMNLFL QWVENMKLCSDVVLANSFTEIEGKYLDYVSEMLKKKVPVGPLIVTASDVANEKSDVLDWLDKK QPKSTVYVSFGSEYYLSKEDREELAHGLELSGANFIWIVRFPKGDEMGIEEALPEGFIERIGER GILVDGWAPQLKILKHSSIGGFVCHCGWNSVVEAVVHGVPIIALPMQLDQPFHARVATAAAGIG VEAERGVDGAVRQGVAKAIKQVLFEKTGEDFKLKAKEICEILKDKGQNIKTCVAELHQL | 1140 | Cla020505 |
| UGT super family protein [Cucurbita moschata (Rifu)] | MDAQQAANKSPTASTIFMLPWVGYHLSAYLELAKALSTRNFHVYFCSTPVSLASIKPRLIPSC SSIQFVELHLPSSDEFPPHLHTTNGLPAHIVPTIHQAFAAAAQTFEAFLQTLRPHLLIYDSLQP WAPRIASSLNIPAINFFTAGAFAVSHVLRAFHYPDSQFPSSDFVLHSRMKIKNTTAESPTQVKI PKIGRAIGYCLNASRGVILTNSFRELEGKYIDYLSVILKKRVLPIGPLVVQPNQDEEDEDYSRI KNWLDRKEASSTVLVSFGSEFFLSKEETEAIAHGLEQSEANFIWGIRRPPKGAKKNAIEEALPEG FLERVGGRAMVEEWVPQQGKILKHGNIGGFVSHCGWNSAMESIMCGVPVIGIPMQVDQPFNAGI LEEAGVGVEAKRDSDGKIQRDEVAKLIKEVVVERTREDIRNKLEINEILRTREEKLDELATE ISLL | 1141 | CmoCh02G012250.1 |
| UGT super family protein [Cucurbita moschata (Rifu)] | MEGNRHGKTSVLMLPWLAHGHVSPFFELAKSLRRRNFHIYFCSTSVIINSIQSNLTRDLSSDIE LVELKLPTSSDLPPYRHTTAGLPPHLMFSLKRAFDSAAATFSIILHNLNPDLVIYDFLQPWAPT VARSSHIPAVMFQPTGALMAAMVKYELEYPSSDLSSIFPDIRLTEYEIKQVKNLFRSSVNDARD EERIKECNERSCGMILVKSFREIEGKYIDFLSILLRKKVVPVGPLVQEPENDVVSRRRFEKWLN KKQDSSCLLVSFGSEFYLSKEDMEEIAYGLELSHVDFIWVVRFPVAGGGERKKNVEEELPKGFI ERVRERGMVVEGWVPQAQILKHRTTGGFLSHCGWSSVMESIKFGVPIIAAPMQLDQPLNARLVE WLDVGVVIERDNGRLRRQEVARVVKEVMVEKMGERVRKKVKEFAEMLKKKGDEEMDMVVEELVK LCKSNKEDNLESHWCRPAIDSHFCEPR | 1142 | CmoCh04G026470.1 |
| UGT super family protein [Cucurbita moschata (Rifu)] | MEPKKPTKKILMFPWLAFGHISPPIQLAKHLSNTPEIHLCSSPVNLQSIQSKLPRTPSNPIHLL HLNLPPSPELPPHMSTNGLPLRLIPTLLNAFDKAAPDFTSIILHKLNPDLLITDMFQPWAVHSA AALNIPAVFFLVVGAGTFSHSVHSVLHHGVDFPPPELDLQNHWLFKRHQONDPSDSSVGATSRF LQLVKDLEVYSDVVLVNSFMEIESKYIDYLSVLFKKKVPVGPLVALSDEKSDVLDWLDQKEPK STVVVSFGSEYYLSNEDRAELAMGLEMSGANFIWVIRFGKGESVGIREALPEGFIERVGERGLV VDGWAPQMGILKHTSIGGFVCHCGWNSVVEAAVNAVPIIALPMQLDQPFHGKVAVAAGVAEAA RGVDGAVQRGVAKAIKEVLFEKKGEELSGKAKEICESLKVKDGKNIDTCWSMHGSLEQVRSHT | 1143 | CmoCh18G009370.1 |
| UGT super family protein [Cucurbita moschata (Rifu)] | MDAQKAVDTPPTTVLMLPWIGYGHLSAYLELAKALSRRNFHVYFCSTPVNLDSIKPNLIPPPS IQFVDLHLPSSPELPPHLHTTNGLPSHLKPTLHQAFSAAAQHFEAILQTLSPHLLIYDSLQPWA PRIASSLNIPAINFNTTAVSIIAHALHSVHYPDSKFPPSDFVLLKKKVVSVGPLVVEPSEGEDEYWRIKK GVEAFLYCLNASCDVVLVNSFRELEGEYMDYLSVLLKKKVVSVGPLVVEPSEGEDEEYWRIKK WLDEKEALSTVLVSFGSEYFPPKEEMEEIAHGLEESEANFIWVVRFPKGEESSRGIERALPKG | 1144 | CmoCh20G000200.1 |

TABLE 1-continued

Some protein and DNA sequences disclosed herein

| Protein/DNA Description | Protein/DNA Sequence | SEQ ID NO | Accessio No./Reference |
|---|---|---|---|
| UGT super family protein [Lagenaria siceraria (Bottle gourd)] | FVERAGERAMVKKWAPQGKILKHGSIGGFVSHCGWNSVLESIRFGVPVIGAPMHLDQPYNAGL LEEAGIVEAKRDADGKIQRDQVASLIKQVVEKTREDIWKKVREMREVLRRDDDDMIDEMV AVISVLKI | 1145 | Lsi10G009490.1 |
| UGT super family protein [Lagenaria siceraria (Bottle gourd)] | MDGQQGGSNTSTPTTILMPWIGYGHLCAYLELAKALSRNNFHIYFCSTPVCLDSIKPKLIPS SSIEFVEFHLFPSPELPPHLHTINGVPPHIALTLHQAATAAAPRPESILQTLSPHLLIYDCFQP WAPRIASTLNIPAINFSTIGASIVSHEFHSIHYPDSKFPPSNFVLHNYWKAKLKSVTSEGACII EGFFNCFNASCDVILMNSFREIEGEYMNYVSLLITKKKVIPVGPLVYPNEEEEEDENYSRIKNWL DKKETLSTVLVSLGSERTASEEEINEIGKGLEEESEVNFIWVERSNSKGDEEQKRREFVEMVGER VMVVKGWAPQGKILKHGSIGGFVSHCGWNSVLESITFGVPIIGVPIFGDQPFNAIVVEEAGLGV EAKRDSDGKIQRKEIARLIKEVVVEKTREEIRMKVREMSEILRRKGDDKIDEMLSQISLLLNI | 1146 | Lsi10G009510.1 |
| Glycosyltransferase [Cucumis melo (Melon)] | MDAQQAGSNTPTPTTILMLPWLGYGHVSAYFELAKALSRNNFHIYLCSTPVNLDFIKSKLIPS SSSFIQFVELHLPSSPEFPPHVHTTNALPVHLTPTLHQAFDAAAPRFEAILQTLSPHLLIYDYF QSWAPRLASSLNIPAINFNTSGTSMICHGFHSIHYPNSKFPVSDFVLHNHWKAKFNSALSEHAR SVKEAFFYCFNASCDVILTNSFREVDKGFHMDYLSLLLKKVIPIGPLVYKPNEEEEDEDYWRIK NWLDKKEALSTVLVSFGSESYASEEEKEEVGNGLEESETNFIWERVSLKEDQEQERRGFVERA GERAIVLKGWAPQGKILKHGSIGGFVSHCGWNSVLESIVSGVPIIGVPLSGDQPFNVGVVEEAG VGVEAKRDPNGKIQRQEVAKLIKQVVEKTREELRMKVREMSEILRKKRDEKIDEMLAQISLLC NI | 1147 | MELO3C014696P1 |
| UGT [Cucumis melo (Melon)] | MDAHQASDPTTTILMPFMPWLRYGHLSAYLELSKALSSRKNFLIYFCSTPVNLDSIKPKLIPSPS IQFVELHLPSSPEFPPHLHTTKALPLHLTPALHQAFAAAAPLFETILKTLSPHLLIYDCFQSWA PRLASSLNIPAINFNTSGASIISYAFHSIHRPGSKFPISDFVLHNHWNSKYNSTLREHAHCVKE AFFECLNTSRDVILINSFKEVEGEYMDYISLLSLLKKKVIPVGPLVYEPNEKDEEDEDYSRIKNWL DKKEALSTVLVSLGSESYASEEEKEEIVKGLVESGANFIWERINQKGDEEQQIKRRELLEKGG ERAMVKGWAPQGKILKHGSIGGFVSHCGWNSVLESTVSGVPIIGVPLFGDQPFNAGVVEEAGI GVEAKRDHDGKIQRQEVAKLIKEVVVEKSREEIRMRVREMSEIVKRRGDEKIEELLTQISRLSN IS | 1148 | MELO3C018468P1 |
| beta-D-glucosyl crocetin beta-1, 6-glucosyltransferase-like [Momordica charantia] | MATEGRQLHIFMFPPMAHGHMIPIVNMAKLFASRGIKITIVITPLNSISISRSLHNDSNSLDIH LLILKFPSAEVGLPPDCENVDSLPTMDLLPIFYQAINLLQPSLEEALHQNRPHCLVADMFPWT NDVADRIGIPRLIFHGTGSPSLCASEFVRLHQPYKHVSSDTEHFLIPYLPGDIKLTKMQLPIIL RENVENEYSKFITKVKESESYCYGVVVNSFYELEAEYVDCYRNVLGRKAWPIGPLSLWNNETEQ ISQRGTGSTIDEHECLKWLDLQKPNSVVVICFGSLAKFNSAQLKEIAIGVEASGKFIWVVRKG KGEEEBEDEQWMLPKGYEQRMEGRGLIIRGWAPQVLILDHLAVGGFVTHCGWNSTLEGVVAGLPM VTWPVAABQFYNEKLLTEVLKIGVGVGVQKMAPGVGDFIKSEVVEKAIKRIMEEEGEEMRNRAI EFAKKAERAIEKDGSSYLNLDALIEELKSLAF | 1149 | XP_022156002 |
| beta-D-glucosyl crocetin beta-1, 6-glucosyltransferase-like [Momordica charantia | MDARQQAEHTTTILMLPWVGYGHLSAYLELAKALSRRNFHIYYCSTPVNIESIKPKLTIPCSSI QFVELHLPFSDDLLPPNLHTTNGLPSHLMPALHQAFSAAAPLFEAILQTLCPHLLIYDSLQPWAP QIASSLKIPALNFNTGVSVIARALHTIHHPDSKFPLSEIVLHNYWKATHATADGANPEKFRRD LEAALLCCLHSSCNAILINTPRELEGEYIDYLSLLLNKKVTPIGPLVYEPNQDEEQDEEYRSIKN WLDKKEPYSTIFVSPGSEYFPSNEEMEEIARGLEESGANFIWVRFHKLENGNGITEEGLLERA GERGMVIQGWAPQARILRHGSIGGFVSHCGWNSVMESIICGVPIVGVPMGLDQPYNAGLVEEAG VGVEAKRDPDGKIQRHEVSKLIKQVVVEKTRDDVRKKVAQMSEILRRKGDEKIDEMVALISLLL KG | | |

While the invention has been described with reference to the specific embodiments thereof, it should be understood by those skilled in the art that various changes may be made and equivalents may be substituted without departing from the true spirit and scope of the invention. This includes embodiments which do not provide all of the benefits and features set forth herein. In addition, many modifications may be made to adapt a particular situation, material, composition of matter, process, process step or steps, to the objective, spirit and scope of the present invention. All such modifications are intended to be within the scope of the claims appended hereto. Accordingly, the scope of the invention is defined only by reference to the appended claims.

Further Embodiments

1. A method of producing Compound 1 having the structure of:

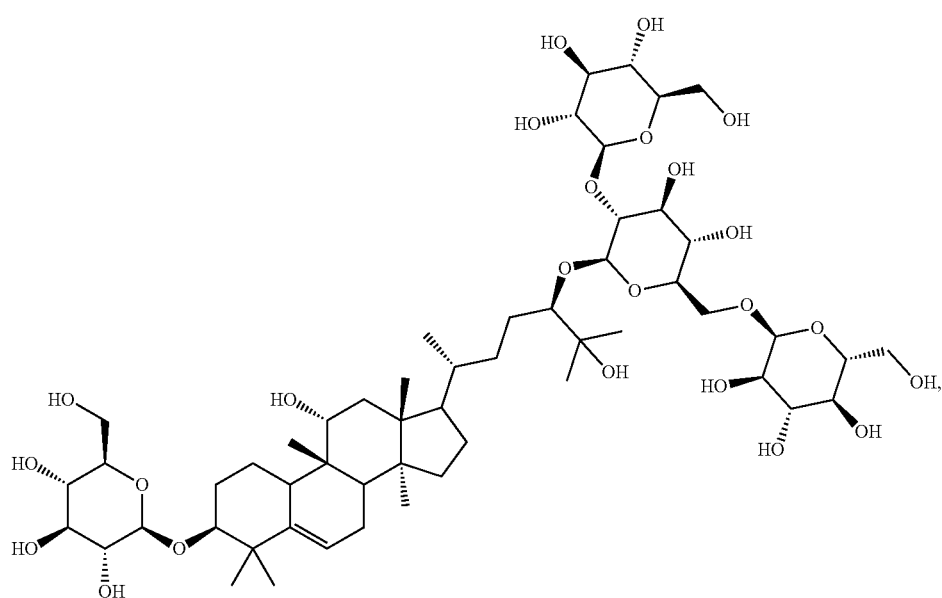

(1)

the method comprising:
contacting mogroside III$_E$ with a recombinant host cell that comprises a first enzyme capable of catalyzing a production of Compound 1 from mogroside III$_E$, wherein the recombinant host cell comprises:
(1) a cytochrome P450 that comprises an amino acid sequence having at least 80% sequence identity to the sequence of any one of SEQ ID NOs: 1025, 1027, 1029, 1031, 1033, 1035, 1037, 1039, 1041, 1043, 1045, 1047, and 1049; and/or
(2) a cytochrome P450 that is encoded by a nucleic acid sequence having at least 80% sequence identity to any one of SEQ ID NOs: 1024, 1026, 1028, 1030, 1032, 1034, 1036, 1038, 1040, 1042, 1044, 1046, and 1048; and/or
(3) a glycosylating enzyme that comprises an amino acid sequence having at least 80% sequence identity to the sequence of any one of SEQ ID NOs: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or
(4) a glycosylating enzyme that is encoded a nucleic acid sequence having at least 80% sequence identity to the sequence of any one of SEQ ID NOS: 1050, 1052, 1054, 1056, 1058, 1060, 1062, 1064, 1066, 1068, 1070, 1075, 1077, 1079, 1081, 1083, 1085, 1087, 1089, 1091, and 1093; and/or
(5) an epoxide hydrolase that comprises an amino acid sequence having at least 80% sequence identity to the sequence of SEQ ID NO: 1073; and/or
(6) an epoxide hydrolase that is encoded by a nucleic acid sequence having at least 80% sequence identify to the sequence of SEQ ID NO: 1072.

2. The method of Embodiment 1, wherein the recombinant host cell comprises
(1) a cytochrome P450 that comprises an amino acid sequence having at least 95% sequence identity to the sequence of any one of SEQ ID NOs: 1025, 1027, 1029, 1031, 1033, 1035, 1037, 1039, 1041, 1043, 1045, 1047, and 1049; and/or
(2) a cytochrome P450 that is encoded by a nucleic acid sequence having at least 95% sequence identity to any one of SEQ ID NOs: 1024, 1026, 1028, 1030, 1032, 1034, 1036, 1038, 1040, 1042, 1044, 1046, and 1048; and/or
(3) a glycosylating enzyme that comprises an amino acid sequence having at least 95% sequence identity to the sequence of any one of SEQ ID NOs: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or
(4) a glycosylating enzyme that is encoded a nucleic acid sequence having at least 95% sequence identity to the sequence of any one of SEQ ID NOs: 1050, 1052, 1054, 1056, 1058, 1060, 1062, 1064, 1066, 1068, 1070, 1075, 1077, 1079, 1081, 1083, 1085, 1087, 1089, 1091, and 1093; and/or
(5) an epoxide hydrolase that comprises an amino acid sequence having at least 95% sequence identity to the sequence of SEQ ID NO: 1073; and/or
(6) an epoxide hydrolase that is encoded by a nucleic acid sequence having at least 95% sequence identify to the sequence of SEQ ID NO: 1072.

3. The method of Embodiment 1, wherein the recombinant host cell comprises
   (1) a cytochrome P450 that comprises an amino acid sequence having at least 95% sequence identity to the sequence of any one of SEQ ID NOs: 1025, 1027, 1029, 1031, 1033, 1035, 1037, 1039, 1041, 1043, 1045, 1047, and 1049; and/or
   (2) a cytochrome P450 that is encoded by a nucleic acid sequence having at least 95% sequence identity to any one of SEQ ID NOs: 1024, 1026, 1028, 1030, 1032, 1034, 1036, 1038, 1040, 1042, 1044, 1046, and 1048; and/or
   (3) a glycosylating enzyme that comprises an amino acid sequence having at least 95% sequence identity to the sequence of any one of SEQ ID NOs: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or
   (4) a glycosylating enzyme that is encoded a nucleic acid sequence having at least 95% sequence identity to the sequence of any one of SEQ ID NOs: 1050, 1052, 1054, 1056, 1058, 1060, 1062, 1064, 1066, 1068, 1070, 1075, 1077, 1079, 1081, 1083, 1085, 1087, 1089, 1091, and 1093; and/or
   (5) an epoxide hydrolase that comprises an amino acid sequence having at least 95% sequence identity to the sequence of SEQ ID NO: 1073; and/or
   (6) an epoxide hydrolase that is encoded by a nucleic acid sequence having at least 95% sequence identify to the sequence of SEQ ID NO: 1072.

4. The method of any one of Embodiments 1-3, wherein the recombinant host cell comprises a first gene encoding the first enzyme.

5. The method of Embodiment 4, wherein the first gene is heterologous to the recombinant host cell.

6. The method of any one of Embodiments 1-5, wherein the mogroside $III_E$ is present in and/or produced by the recombinant host cell.

7. The method of any one of Embodiments 1-6, comprising cultivating the recombinant host cell in a culture medium under conditions in which the first enzyme is expressed.

8. The method of any one of Embodiments 1-7, wherein the first enzyme is one or more of UDP glycosyltransferases, cyclomaltodextrin glucanotransferases (CGTases), glycotransferases, dextransucrases, cellulases, β-glucosidases, amylases, transglucosidases, pectinases, and dextranases.

9. The method of Embodiment 8, wherein the CGTase comprises an amino acid sequence having at least 70% sequence identity to the sequence of any one of SEQ ID NOs: 1, 3, 78-101, 148, and 154.

10. The method of Embodiment 8, wherein the dextransucrase comprises an amino acid sequence having at least 70% sequence identity to any one of the sequences set forth in SEQ ID NOs: 2, 103, 106-110, 156, 159-162, and 896; or wherein the dextransucrase is encoded by a nucleic acid sequence having at least 70% sequence identity to any one of SEQ ID NOs: 104, 105, 157, 158, and 895.

11. The method of Embodiment 8, wherein the transglucosidase comprises an amino acid sequence having at least 70% sequence identity to the sequence of any one of SEQ ID NOs: 163-291 and 723.

12. The method of Embodiment 8, wherein the beta-glucosidase comprises an amino acid sequence having at least 70% sequence identity to the sequence set forth in any one of SEQ ID NOs: 102, 292, 354-374, and 678-741.

13. The method of any one of Embodiments 1-12, comprising contacting mogroside IIA with the recombinant host cell to produce mogroside $III_E$, wherein the recombinant cell comprises a second enzyme capable of catalyzing a production of mogroside IIIE from mogroside IIA.

14. The method of Embodiment 13, wherein the recombinant host cell comprises a second gene encoding the second enzyme.

15. The method of Embodiment 14, wherein the mogroside IIA is produced by and/or present in the recombinant host cell.

16. The method of any one of Embodiments 13-15, wherein the second enzyme is one or more of uridine diphosphate-glucosyl transferase (UGT), CGTases, glycotransferases, dextransucrases, cellulases, β-glucosidases, amylases, transglucosidases, pectinases, and dextranases.

17. The method of Embodiment 16, wherein the UGT is UGT73C3 (SEQ ID NO: 4), UGT73C6 (SEQ ID NO: 5), UGT85C2 (SEQ ID NO: 6), UGT73C5 (SEQ ID NO: 7), UGT73E1 (SEQ ID NO: 8), UGT98 (SEQ ID NO: 9 or 407), UGT1576 (SEQ ID NO:15), UGT SK98 (SEQ ID NO:16), UGT430 (SEQ ID NO:17), UGT1697 (SEQ ID NO:18), UGT11789 (SEQ ID NO:19), or comprises an amino acid sequence having at least 70% sequence identity to any one of SEQ ID NOs: 4-9, 15-19, 125, 126, 128, 129, 293-307, 407, 409, 411, 413, 439, 441, 444, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149.

18. The method of Embodiment 16, wherein the UGT is encoded by a nucleic acid sequence comprising at least 70% sequence identity to any one of the sequences set forth in UGT1495 (SEQ ID NO: 10), UGT1817 (SEQ ID NO: 11), UGT5914 (SEQ ID NO: 12), UGT8468 (SEQ ID NO:13), UGT10391 (SEQ ID NO:14), and SEQ ID NOs: 116-124, 127, 130, 408, 410, 412, 414, 440, 442, 443, 445, 1050, 1052, 1054, 1056, 1058, 1060, 1062, 1064, 1066, 1068, 1070, 1075, 1077, 1079, 1081, 1083, 1085, 1087, 1089, 1091, and 1093.

19. The method of any one of Embodiments 1-18, comprising contacting mogrol with the recombinant host cell, wherein the recombinant host cell comprises one or more enzymes capable of catalyzing a production of mogroside IIE and/or IIIE from mogrol.

20. The method of Embodiment 19, wherein the recombinant host cell comprises one or more genes encoding the one or more enzymes capable of catalyzing production of mogroside IIE and/or IIIE from mogrol.

21. The method of Embodiment 19 or 20, wherein the mogrol is produced by and/or present in the recombinant host cell.

22. The method of any one of Embodiments 19-21, wherein the one or more enzymes capable of catalyzing a production of mogroside IIE and/or IIIE from mogrol comprises one or more of UGTs, CGTases, glycotransferases, dextransucrases, cellulases, β-glucosidases, amylases, transglucosidases, pectinases, and dextranases.

23. The method of Embodiment 22, wherein the UGT is UGT73C3, UGT73C6, 85C2, UGT73C5, UGT73E1, UGT98, UGT1495, UGT1817, UGT5914, UGT8468, UGT10391, UGT1576, UGT SK98, UGT430, UGT1697, or UGT11789, or comprises an amino acid sequence having at least 70% sequence identity to any one of SEQ ID NOs: 4-9, 15-19, 125, 126, 128, 129, 293-307, 405, 406, 407, 409, 411, 413, 439, 441, 444, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149.

24. The method of any one of Embodiments 1-23, comprising contacting a mogroside compound with the recombinant host cell, wherein the recombinant host cell comprises one or more enzymes capable of catalyzing a production of mogroside IIIE from a mogroside compound to produce mogroside IIIE, wherein the mogroside compound is one or more of mogroside IA1, mogroside IE1, mogroside IIA1, mogroside IIE, mogroside IIA, mogroside IIIA1, mogroside IIIA2, mogroside III, mogroside IV, mogroside IVA, mogroside V, and siamenoside.

25. The method of Embodiment 24, wherein the recombinant host cell comprises one or more genes encoding the one or more enzymes capable of catalyzing the production of Mogroside IIIE from the mogroside compound.

26. The method of Embodiment 25, wherein the mogroside compound is produced by and/or present in the recombinant host cell.

27. The method of any one of Embodiments 24-26, wherein the one or more enzymes capable of catalyzing the production of mogroside IIIE from the mogroside compound comprises one or more of UGTs, CGTases, glycotransferases, dextransucrases, cellulases, β-glucosidases, amylases, transglucosidases, pectinases, and dextranases.

28. The method of any one of Embodiments 24-27, wherein the mogroside compound is mogroside IIE.

29. The method of any one of Embodiments 24-27, wherein the mogroside compound is morgroside IIA or mogroside IIE, and wherein the contacting with one or more enzymes produces one or more of mogroside IIIA, mogroside IVE and mogroside V.

30. The method of any one of Embodiments 1-29, comprising contacting mogroside $I_{A1}$ with the recombinant host cell, wherein the recombinant host cell comprises a gene encoding UGT98 or UGT SK98 enzyme comprises an amino acid sequence having at least 70% sequence identity to SEQ ID NO: 9, 407, 16, or 306.

31. The method of Embodiment 30, wherein the contacting results in production of Mogroside IIA in the cell 32. The method of any one of Embodiments 1-31, wherein the method comprises contacting 11-hydroxy-24,25 epoxy cucurbitadienol with the recombinant host cell, wherein the recombinant host cell comprises a third gene encoding an epoxide hydrolase.

33. The method of Embodiment 32, wherein the 11-hydroxy-24,25 epoxy cucurbitadienol is present in and/or produced by the recombinant host cell.

34. The method of any one of Embodiments 1-33, wherein the method comprises contacting 11-hydroxy-cucurbitadienol with the recombinant host cell, wherein the recombinant host cell comprises a fourth gene encoding a cytochrome P450 or an epoxide hydrolase.

35. The method of Embodiment 34, wherein the 11-hydroxy-cucurbitadienol is produced by and/or present in the recombinant host cell.

36. The method of any one of Embodiments 1-35, wherein the method comprises contacting 3, 24, 25-trihydroxy cucurbitadienol with the recombinant host cell, wherein the recombinant host cell comprises a fifth gene encoding a cytochrome P450.

37. The method of Embodiment 36, wherein the 3, 24, 25-trihydroxy cucurbitadienol is present in and/or produced by the recombinant host cell.

38. The method of any one of Embodiments 32-37, wherein the contacting results in production of Mogrol in the recombinant host cell.

39. The method of Embodiment 34 or 35, wherein the epoxide hydrolase comprises an amino acid sequence having at least 70% sequence identity to any one of SEQ ID NOs: 21-30, 309-314 and 1073; or the epoxide hydrolase is encoded by a nucleic acid sequence having at least 70% sequence identity to any one of SEQ ID NOs: 114, 115 and 1072.

40. The method of any one of Embodiments 1-39, wherein the method comprises contacting cucurbitadienol with the recombinant host cell.

41. The method of Embodiment 40, wherein the contacting results in production of 11-hydroxy cucurbitadienol.

42. The method of Embodiment 40 or 41, wherein the cucurbitadienol is produced by and/or present in the recombinant host cell.

43. The method of any one of Embodiments 1-42, wherein the method comprises contacting one or more of 2, 3-oxidosqualene, dioxidosqualene and diepoxysqualene with the recombinant host cell, wherein the recombinant host cell comprises a seventh gene encoding a polypeptide having cucurbitadienol synthase activity.

44. The method of Embodiment 43, wherein the polypeptide having cucurbitadienol synthase activity is a fusion protein comprising a fusion domain fused to a cucurbitadienol synthase.

45. The method of Embodiment 43 or 44, wherein the contacting results in production of cucurbitadienol and/or 24, 25-epoxy cucurbitadienol.

46. The method of any one of Embodiments 43-45, wherein one or more of 2,3-oxidosqualene, dioxidosqualene and diepoxysqualene is produced by and/or present in the recombinant host cell.

47. The method of any one of Embodiments 1-46, wherein the recombinant host cell comprises a gene encoding CYP87D18 or SgCPR protein.

48. The method of any one of Embodiments 1-47, wherein the method comprises contacting squalene with the recombinant host cell, wherein the recombinant host cell comprises an eighth gene encoding a squalene epoxidase.

49. The method of Embodiment 48, wherein the contacting results in production of 2,3-oxidosqualene.

50. The method of Embodiments 48 or 49, wherein the squalene is produced by and/or present in the recombinant host cell.

51. The method of any one of Embodiments 1-50, wherein the method comprises contacting farnesyl pyrophosphate with the recombinant host cell, wherein the recombinant host cell comprises a ninth gene encoding a squalene synthase.

52. The method of Embodiment 51, wherein the contacting results in production of squalene.

53. The method of Embodiment 51 or 52, wherein the farnesyl pyrophosphate is produced by and/or present in the recombinant host cell.

54. The method of any one of Embodiments 51-53, wherein the squalene synthase comprises an amino acid sequence having at least 70% sequence identity to any one of SEQ ID NOs: 69 and 336, or wherein the squalene synthase is encoded by a sequence comprising a nucleic acid sequence having at least 70% sequence identity to SEQ ID NO: 337.

55. The method of any one of Embodiments 1-54, wherein the method comprises contacting geranyl-PP with the recombinant host cell, wherein the recombinant host cell comprises a tenth gene encoding farnesyl-PP synthase.

56. The method of Embodiment 55, wherein the contacting results in production of farnesyl-PP.

57. The method of Embodiment 55 or 56, wherein the geranyl-PP is produced by and/or present in the recombinant host cell.

58. The method of any one of Embodiments 55-57, wherein the farnesyl-PP synthase comprises an amino acid sequence having at least 70% sequence identity to SEQ ID NO: 338, or is encoded by a nucleic acid sequence having at least 70% sequence identity to SEQ ID NO: 339.

59. The method of any one of Embodiments 1-58, wherein one or more of the first, second, third, fourth, fifth, sixth, seventh, eighth, ninth, and tenth gene is operably linked to a heterologous promoter.

60. The method of Embodiment 59, wherein the promoter is an inducible, repressible, or constitutive promoter.

61. The method of any one of Embodiments 1-60, wherein the recombinant host cell is a plant, bivalve, fish, fungus, bacteria, or mammalian cell.

62. The method of Embodiment 61, wherein the fungus is selected from the group consisting of *Trichophyton, Sanghuangporus, Taiwanofungus, Moniliophthora, Marssonina, Diplodia, Lentinula, Xanthophyllomyces, Pochonia, Colletotrichum, Diaporthe, Histoplasma, Coccidioides, Histoplasma, Sanghuangporus, Aureobasidium, Pochonia, Penicillium, Sporothrix, Metarhizium, Aspergillus, Yarrowia*, and *Lipomyces*.

63. The method of Embodiment 61, wherein the fungus is *Aspergillus nidulans, Yarrowia lipolytica*, or *Rhodosporin toruloides*.

64. The method of Embodiment 61, wherein the recombinant host cell is a yeast cell.

65. The method of Embodiment 64, wherein the recombinant host cell is a *Saccharomyces cerevisiae* cell or a *Yarrowia lipolytica* cell.

66. The method of any one of Embodiments 1-65, comprising isolating Compound 1.

67. The method of Embodiment 66, wherein isolating Compound 1 comprises lysing the recombinant host cell and/or isolating Compound 1 from the culture medium.

68. The method of any one of Embodiment 1-67, comprising purifying Compound 1.

69. The method of Embodiment 68, wherein purifying Compound 1 comprises HPLC, solid phase extraction, or a combination thereof.

70. The method of any one of Embodiments 1-69, comprising contacting a first mogroside with the recombinant host cell to produce mogroside IIIE before contacting the mogroside IIIE with the first enzyme, wherein the recombinant host cell comprises a hydrolase.

71. The method of Embodiment 70, wherein the hydrolase is a β-glucan hydrolase. 72. The method of Embodiment 70, wherein the hydrolase is EXG1 or EXG2.

73. The method of any one of Embodiments 70-72, wherein the first mogroside is selected from the group consisting of a mogroside IV, a mogroside V, a mogroside VI, a siamenoside I, a mogroside IVE, a mogroside IVA, and combinations thereof.

74. The method of any one of Embodiments 70-73, wherein the recombination host cell comprises a gene encoding the hydrolase.

75. The method of any one of Embodiments 70-74, wherein the first mogroside is produced by and/or present in the recombinant host cell.

76. The method of any one of Embodiments 1-75, wherein the recombinant cell further comprises an oxidosqualene cyclase or a nucleic acid sequence encoding an oxidosqualene cyclase, and wherein the oxidosqualene cyclase has been modified to produce cucurbitadienol or epoxycucurbitadienol.

77. The method of Embodiment 76, wherein the oxidosqualene cyclase is a cycloartenol synthase or a beta-amyrin synthase.

78. The method of any one of Embodiments 1-77, wherein the recombinant cell comprises cytochrome P450 reductase or a gene encoding cytochrome P450 reductase.

79. A compound having the structure of Compound 1,

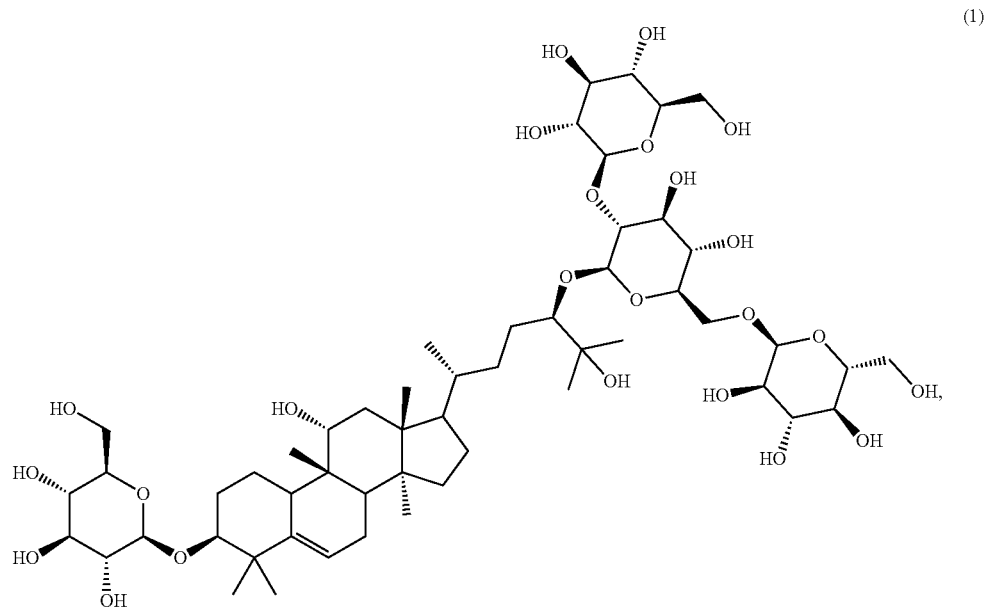 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

wherein the compound is produced by the method of any one of Embodiments 1-78.

80. A recombinant cell comprising: Compound 1 having the structure:

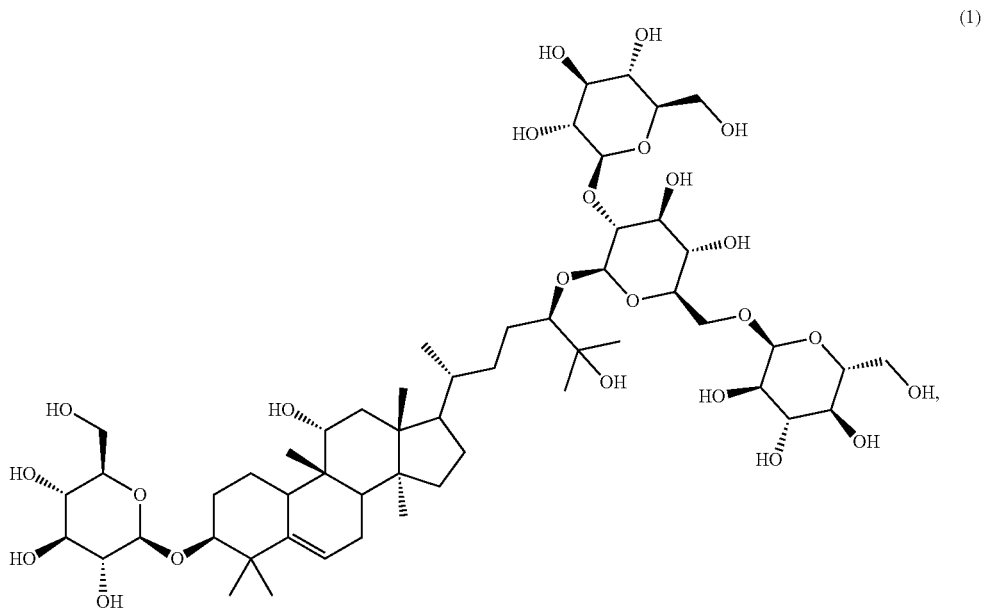 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

a gene encoding an enzyme capable of catalyzing production of Compound 1 from mogroside $I_E$, and one or more of (1) a cytochrome P450 that comprises an amino acid sequence having at least 80% sequence identity to the sequence of any one of SEQ ID NOs: 1025, 1027, 1029, 1031, 1033, 1035, 1037, 1039, 1041, 1043, 1045, 1047, and 1049; and/or (2) a cytochrome P450 that is encoded by a nucleic acid sequence having at least 80% sequence identity to any one of SEQ ID NOs: 1024, 1026, 1028, 1030, 1032, 1034, 1036, 1038, 1040, 1042, 1044, 1046, and 1048; and/or (3) a glycosylating enzyme that comprises an amino acid sequence having at least 80% sequence identity to the sequence of any one of SEQ ID NOS: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or (4) a glycosylating enzyme that is encoded a nucleic acid sequence having at least 80% sequence identity to the sequence of any one of SEQ ID NOS: 1050, 1052, 1054, 1056, 1058, 1060, 1062, 1064, 1066, 1068, 1070, 1075, 1077, 1079, 1081, 1083, 1085, 1087, 1089, 1091, and 1093; and/or (5) an epoxide hydrolase that comprises an amino acid sequence having at least 80% sequence identity to the sequence of SEQ ID NO: 1073; and/or (6) an epoxide hydrolase that is encoded by a nucleic acid sequence having at least 80% sequence identify to the sequence of SEQ ID NO: 1072.

81. The recombinant cell of Embodiment 80, wherein the gene is a heterologous gene to the recombinant cell.

82. A recombinant cell comprising a first gene encoding a first enzyme capable of catalyzing production of Compound 1 having the structure:

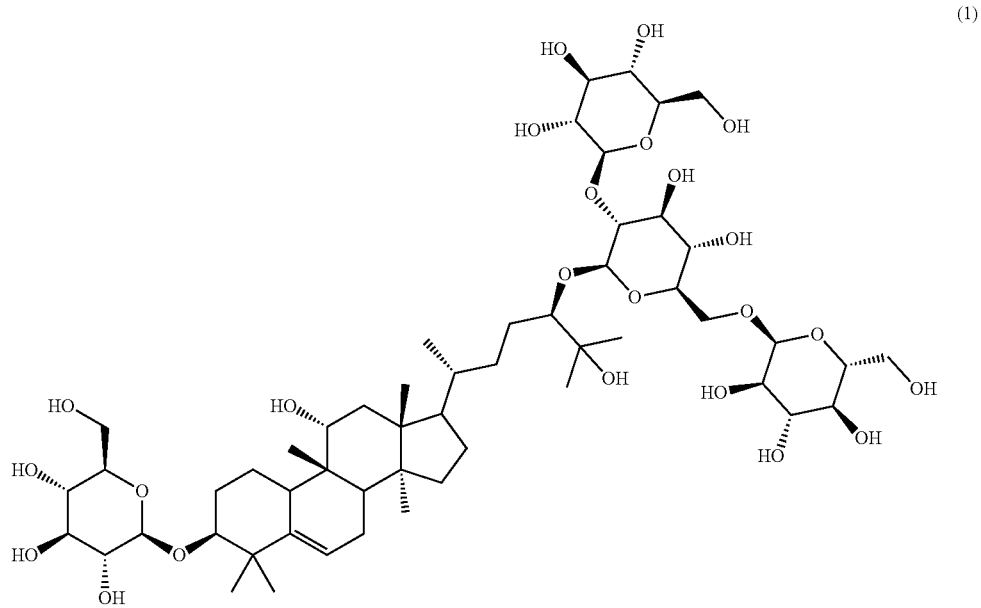 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

from mogroside IIIE, and one or more of
  (1) a cytochrome P450 that comprises an amino acid sequence having at least 80% sequence identity to the sequence of any one of SEQ ID NOs: 1025, 1027, 1029, 1031, 1033, 1035, 1037, 1039, 1041, 1043, 1045, 1047, and 1049; and/or
  (2) a cytochrome P450 that is encoded by a nucleic acid sequence having at least 80% sequence identity to any one of SEQ ID NOs: 1024, 1026, 1028, 1030, 1032, 1034, 1036, 1038, 1040, 1042, 1044, 1046, and 1048; and/or
  (3) a glycosylating enzyme that comprises an amino acid sequence having at least 80% sequence identity to the sequence of any one of SEQ ID NOs: 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; and/or
  (4) a glycosylating enzyme that is encoded a nucleic acid sequence having at least 80% sequence identity to the sequence of any one of SEQ ID NOS: 1050, 1052, 1054, 1056, 1058, 1060, 1062, 1064, 1066, 1068, 1070, 1075, 1077, 1079, 1081, 1083, 1085, 1087, 1089, 1091, and 1093; and/or
  (5) an epoxide hydrolase that comprises an amino acid sequence having at least 80% sequence identity to the sequence of SEQ ID NO: 1073; and/or
  (6) an epoxide hydrolase that is encoded by a nucleic acid sequence having at least 80% sequence identify to the sequence of SEQ ID NO: 1072.

83. The cell of Embodiment 82, wherein the first enzyme is one or more of UGTs, cyclomaltodextrin glucanotransferases (CGTases), glycotransferases, dextransucrases, cellulases, β-glucosidases, amylases, transglucosidases, pectinases, and dextranases.

84. The cell of Embodiment 83, wherein the CGTase comprises an amino acid sequence having at least 70% sequence identity to the sequence of any one of SEQ ID NOs: 1, 3, 78-101, 148, and 154.

85. The cell of Embodiment 83, wherein the dextransucrase comprises an amino acid sequence having at least 70% sequence identity to any one of the sequences set forth in SEQ ID NOs: 2, 103, 106-110, 156 and 896; or wherein the dextransucrase is encoded by an nucleic acid sequence having at least 70% sequence identity to any one of SEQ ID NOs: 104, 105, 157, 158, and 895.

86. The cell of Embodiment 83, wherein the transglucosidase comprises an amino acid sequence having at least 70% sequence identity to the sequence of any one of SEQ ID NOs: 3, 95-102, 163-291, and 723.

87. The cell of Embodiment 83, wherein the beta glucosidase comprises an amino acid sequence having at least 70% sequence identity to SEQ ID NOs: 102, 292, 354-376, and 678-741.

88. The cell of any one of Embodiment 82-87, comprising a second gene encoding a uridine diphosphate-glucosyl transferase (UGT).

89. The cell of Embodiment 88, wherein the UGT comprises an amino acid sequence having at least 70% sequence identity to any one of the sequences set forth in SEQ ID NO: 4-9, 15-19, 125, 126, 128, 129, 293-307, 407, 409, 411, 413, 439, 441, 444, 1051, 1053, 1055, 1057, 1059, 1061, 1063, 1065, 1067, 1069, 1071, 1074, 1076, 1078, 1080, 1082, 1084, 1086, 1088, 1090, 1092, and 1094-1149; or wherein UGT is encoded by a nucleic acid sequence having at least 70% sequence identity to any one of SEQ ID NOs: 116-124, 127, 130, 408, 410, 412, 414, 440, 442, 443, 445, 1050, 1052, 1054, 1056, 1058, 1060, 1062, 1064, 1066, 1068, 1070, 1075, 1077, 1079, 1081, 1083, 1085, 1087, 1089, 1091, and 1093.

90. The cell of Embodiment 88, wherein the UGT is encoded by a sequence set forth in UGT1495 (SEQ ID NO: 10), UGT1817 (SEQ ID NO: 11), UGT5914 (SEQ ID NO: 12), UGT8468 (SEQ ID NO: 13), or UGT10391 (SEQ ID NO: 14).

91. The cell of any one of Embodiments 82-90, comprising a third gene encoding UGT98 or UGT SK98 which comprises an amino acid sequence having at least 70% sequence identity to SEQ ID NO: 9, 407, 16, or 306; or wherein the UGT98 is encoded by a nucleic acid sequence set forth in SEQ ID NO: 307.

92. The cell of any one of Embodiments 82-91, comprising a fourth gene encoding an epoxide hydrolase.

93. The cell of Embodiment 92, wherein the epoxide hydrolase comprises an amino acid sequence having at least 70% sequence identity to any one of SEQ ID NO: 21-30 and 309-314; or is encoded by a nucleic acid sequence having at least 70% sequence identity to any one of SEQ ID NOs: 114 and 115.

94. The cell of any one of Embodiments 82-93, comprising a fifth sequence encoding P450.

95. The cell of Embodiment 94, wherein the P450 comprises an amino acid sequence having at least 70% sequence identity to any one of SEQ ID NOs: 20, 49, 308, 315, 430, 872, 874, 876, 878, 880, 882, 884, 886, 888, 890, 891, 1025, 1027, 1029, 1031, 1033, 1035, 1037, 1039, 1041, 1043, 1045, 1047, 1049, 1025, 1027, 1029, 1031, 1033, 1035, 1037, 1039, 1041, 1043, 1045, 1047, and 1049; or is encoded by a nucleic acid sequence having at least 70% sequence identity to any one of SEQ ID NOs: 31-48, 316, 318, 431, 871, 873, 875, 877, 879, 881, 883, 885, 887, 889, 892, 1024, 1026, 1028, 1030, 1032, 1034, 1036, 1038, 1040, 1042, 1044, 1046, and 1048.

96. The cell of any one of Embodiments 82-95, comprising a sixth sequence encoding a polypeptide having cucurbitadienol synthase activity.

97. The method of Embodiment 96, wherein the polypeptide having cucurbitadienol synthase activity is a fusion protein.

98. The cell of Embodiment 96, wherein the polypeptide having cucurbitadienol synthase activity comprises an amino acid sequence having at least 70% sequence identity to any one of SEQ ID NOs: 70-73, 75-77, 319, 321, 323, 325, 327-333, 417, 420, 422, 424, 426, 446, 902, 904, 906, 851, 854, 856, 1024, 859, 862, 865, 867, 915, 920, 924, 928, 932, 936, 940, 944, 948, 952, 956, 959, 964, 967, 971, 975, 979, 983, 987, 991, 995, 999, 1003, 1007, and 1011; or wherein the polypeptide having cucurbitadienol synthase activity is encoded by a nucleic acid sequence having at least 70% sequence identity to any one of SEQ ID NOs: 74, 320, 322, 324, 326, 328, 418, 421, 423, 425, 427, 897, 899, 901, 903, and 905.

99. The cell of any one of Embodiments 82-98, comprising a seventh gene encoding a squalene epoxidase.

100. The cell of Embodiment 99, wherein the squalene epoxidase comprises an amino acid sequence having at least 70% sequence identity to any one of SEQ ID NOs: 50-56, 60, 61, 334, and 335; or wherein the squalene epoxidase is encoded by a nucleic acid sequence having at least 70% sequence identity to SEQ ID NO: 335.

101. The cell of any one of Embodiments 82-100, comprising an eighth gene encoding a squalene synthase.

102. The cell of Embodiment 101, wherein the squalene synthase comprises an amino acid sequence having at least 70% sequence identity to SEQ ID NO: 69 or 336; or wherein the squalene synthase is encoded by a sequence comprising a nucleic acid sequence set forth in SEQ ID NO: 337.

103. The cell of any one of Embodiments 82-102, comprises a ninth gene encoding a farnesyl-PP synthase.

104. The cell of Embodiment 103, wherein the farnesyl-PP synthase comprises an amino acid sequence having at least 70% sequence identity to SEQ ID NO: 338, or is encoded by a nucleic acid sequence having at least 70% sequence identity to SEQ ID NO: 339.

105. The cell of any one of Embodiments 82-104, wherein the cell is a mammalian, plant, bacterial, fungal, or insect cell.

106. The cell of Embodiment 105, wherein the fungus is *Trichophyton, Sanghuangporus, Taiwanofungus, Moniliophthora, Marssonina, Diplodia, Lentinula, Xanthophyllomyces, Pochonia, Colletotrichum, Diaporthe, Histoplasma, Coccidioides, Histoplasma, Sanghuangporus, Aureobasidium, Pochonia, Penicillium, Sporothrix,* or *Metarhizium.*

107. The cell of any one of Embodiments 82-104, wherein the cell is a yeast cell, wherein the yeast is selected from the group consisting of *Candida, Saccharaomyces, Saccharomycotina, Taphrinomycotina, Schizosaccharomyces, Komagataella, Basidiomycota, Agaricomycotina, Tremellomycetes, Pucciniomycotina, Aureobasidium, Coniochaeta,* and *Microboryomycetes.*

108. The cell of any one of Embodiments 82-106, wherein the recombinant cell comprises a gene encoding at least one hydrolytic enzyme capable of hydrolyzing mogroside V.

109. The cell of anyone of Embodiments 82-108, wherein Compound 1 displays tolerance to hydrolytic enzymes in the recombinant cell, wherein the hydrolytic enzymes display-capabilities of hydrolyzing Mogroside VI, Mogroside V, Mogroside IV to Mogroside IIIE.

110. The cell of any one of Embodiments 82-109, wherein the recombinant cell further comprises an oxidosqualene cyclase or a nucleic acid sequence encoding an oxidosqualene cyclase, and wherein the oxidosqualene cyclase is modified to produce cucurbitadienol or epoxycucurbitadienol.

111. The cell of Embodiment 110, wherein the oxidosqualene cyclase comprises an amino acid sequence having at least 70% sequence identity to any one of SEQ ID NOs: 341, 343 and 346-347.

112. The cell of any one of Embodiments 82-111, wherein the cell comprises cytochrome P450 reductase or a gene encoding cytochrome P450 reductase.

113. The cell of any one of Embodiments 82-112, comprising a gene encoding a hydrolase capable of hydrolyzing a first mogroside to produce mogroside IIIE.

114. The cell of Embodiment 113, wherein the hydrolase is a β-glucan hydrolase.

115. The cell of Embodiment 113, wherein the hydrolase is EXG1 or EXG2.

116. The cell of any one of Embodiments 113-115, wherein the first mogroside is selected from the group consisting of a mogroside IV, a mogroside V, a mogroside VI, a siameneoside I, a mogroside IVE, a mogroside IVA, and combinations thereof.

117. The cell of any one of Embodiments 113-116, wherein the cell is a yeast cell.

118. The cell of Embodiment 117, wherein the cell is *Saccharomyces cerevisiae* or *Yarrowia lipolytica.*

119. A compound having the structure of compound (1):

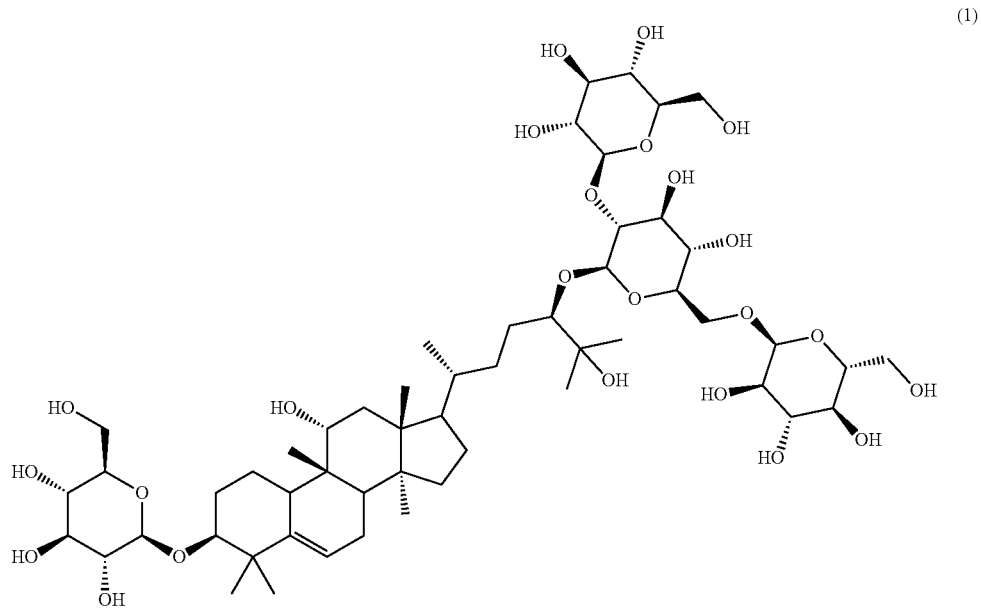 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

wherein the compound is in isolated and purified form.

120. A composition, comprising a compound having the structure of compound (1):

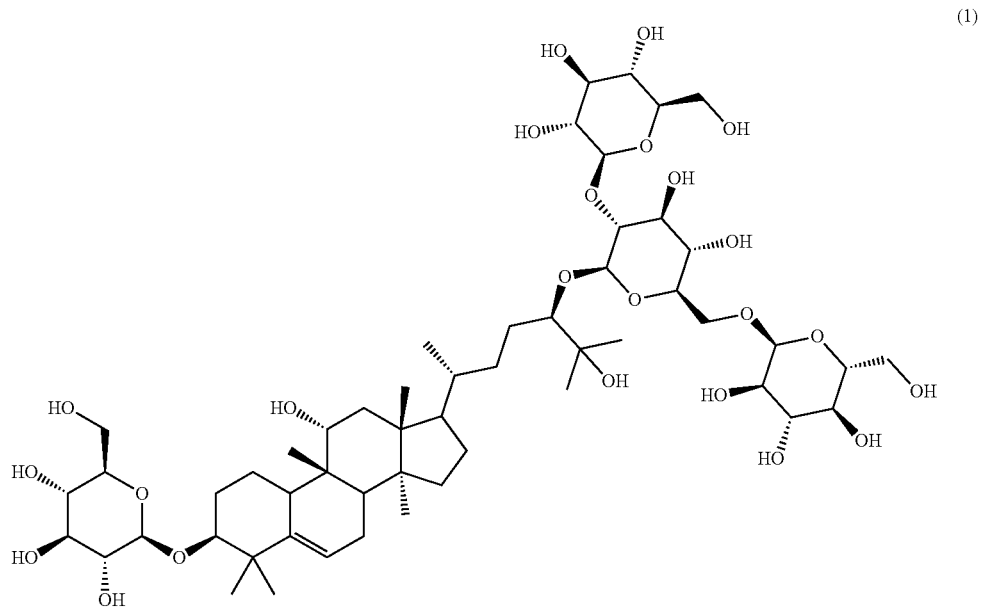 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

wherein the composition comprises greater than 50% by weight of the compound.

121. The composition of Embodiment 120, comprising less than 1%, 0.5%, or 0.1% by weight of Mogroside $III_E$.

122. The composition of Embodiment 120 or 121, comprising less than 0.3%, 0.1%, 0.05%, or 0.01% by weight of 11-oxo-Mogroside $III_E$.

123. The composition of any one of Embodiments 120-122, comprising less than 1%, 0.5%, or 0.1% by weight of all isomers of Mogroside I, Mogroside II, and Mogroside III.

124. The composition of Embodiment 120, comprising less than 0.1% by weight of Mogroside IIIE, 11-oxo-Mogroside IIIE, Mogroside IIIA2, Mogroside IE, and Mogroside IIE.

125. The composition of any one of Embodiments 120-124, comprising less than 1%, 0.5%, or 0.1% by weight of 11-oxo-mogrol.

126. The composition of any one of Embodiments 120-125, comprising greater than 70%, 80%, or 90% by weight of the compound.

127. The composition of any one of Embodiments 120-126, wherein the composition is in solid form.

128. A composition, comprising a solution of a compound having the structure of compound (1):

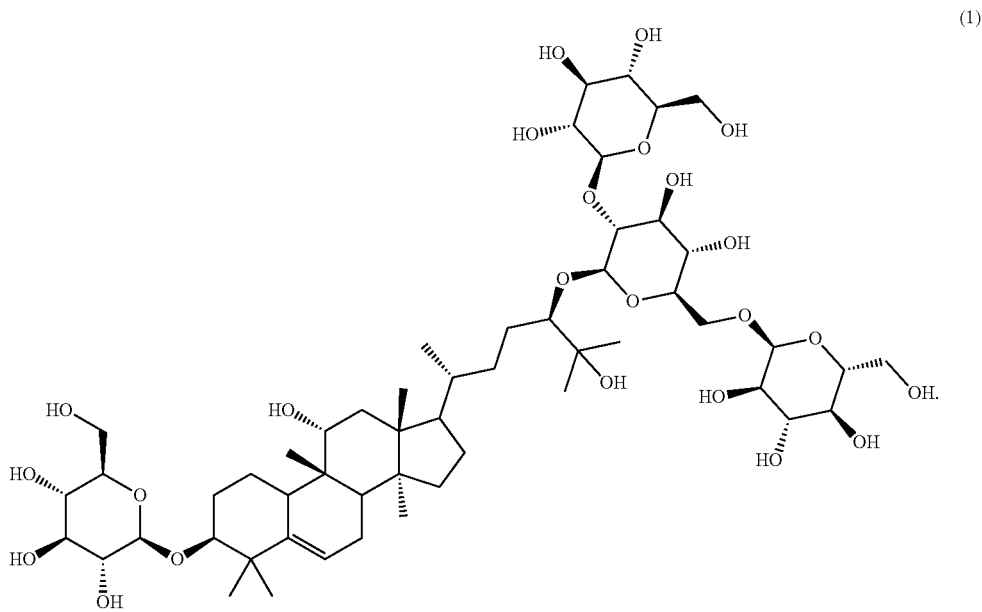 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

129. The composition of Embodiment 128, wherein the concentration of the compound in solution is greater than 500 ppm, 0.1%, 0.5%, 1%, 5%, or 10%.

130. The composition of Embodiment 128 or 129, comprising a concentration of Mogroside $III_E$ that is less than 100 ppm, 50 ppm, 20 ppm or 5 ppm.

131. The composition of any one of Embodiments 128-130, comprising a concentration of 11-oxo-Mogroside IIIE of less than 30 ppm, 10 ppm, 1 ppm, or 0.1 ppm.

132. The composition of Embodiment 128, comprising a combined concentration of all isomers of Mogroside I, Mogroside II, and Mogroside III of less than 1%, 0.5%, 0.1%, 500 ppm, or 100 ppm.

133. The composition of Embodiment 128, comprising a combined concentration of Mogroside IIIE, 11-oxo-Mogroside IIIE, Mogroside IIIA2, Mogroside IE, and Mogroside IIE of less than 500 ppm or 100 ppm.

134. The composition of any one of Embodiments 128-133, comprising a concentration of 11-oxo-mogrol of less than 0.5% or 100 ppm.

135. A composition, comprising a bulking agent and one or more compounds having the structure of compound (1):

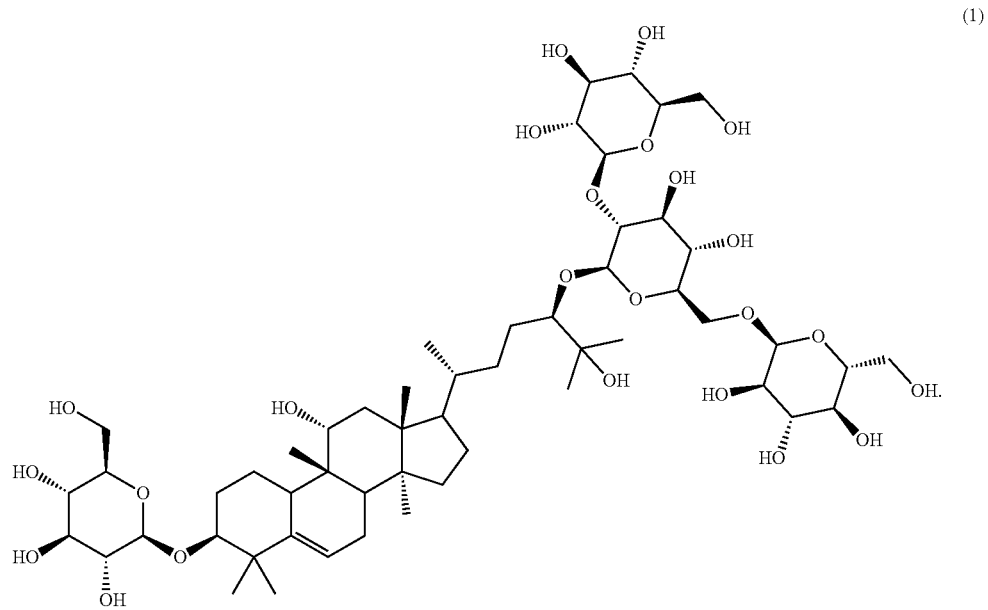 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]

(1)

136. The composition of Embodiment 135, comprising greater than 0.5%, 1%, or 2% by weight of the compound.

137. The composition of Embodiment 135, comprising greater than 30%, 50%, 70%, 90%, or 99% by weight of the bulking agent.

138. A composition comprising the compound of Embodiment 119 and at least one additional sweetener and/or sweet modifier.

139. The use of the composition of Embodiment 138 to convey, enhance, modify, or improve the perception of sweetness of a consumable product.

SEQUENCE LISTING (1149 sequences)

SEQ ID NO: 1 - protein, 694 aa, Artificial Sequence
  Cyclomaltodextrin glucanotransferase (CGTase; Bacillus)
MKEKDKLKVNRNNVNFSKDIIYQIVTDRFHNGCPSYNPKGGLYDESRKNKKKYFGGDWIGIIEKLNTNYFTELGVTSLWISQPVENIFTPINDLVGSTSYHGYWARDFKRTNPFFGTFGDFQTLITTAHAKDIKIIMDFAPNHTSPALHDDATYAENGRLYDNGLLLGGYDNDYNHYFHHNGGTDFEEYEDGVYRNLFDLADLNHQNIAIDLYFKEAIKLWLDQGIDGIRVDAVKHMSYGWQKSWLNSIYNYRPVFIFGEWYINPNEYDHRNVHFANNSGMSLLDFSFAHKVREVFRDGMDSMHGLHKMIEETYQIYNDVNNLVTFIDNHDMDRFHINGQSKRRIEQSLVFLLTSRGIPSVYYGTEQYMVGNGDPNNRGQMESFDVNTDNFKIIQSLSSLRSLNYALPYGNTKERYITNDIYVYERYFGSDVVLIALNRNLTEGYEIKDVKTILPSRKYKDILDGLLDGEAIRVENNNIDSLWLGPGSGQVWHHKGVNSIPLIGTVGHKMTTVGQIICIEGCGFTSKKGSVLFEEKEAEVVSWSHTSIKVKVPAVNDGKYEITVVTDTGTRSNIYKHIEVLNTKQVCIRFVIENGYEIPESEVFIMGNTYSLGNMNPCKAVGPFFNQIMYQFPTGYFDISVPADTLLEFKFIRKINNTLLIEGGENHKYRTPSFGTGEVVVKWQTAEKTILVES

SEQ ID NO: 2 - protein, 1381 aa, Artificial Sequence
  DexT Protein
MPANAPDKQSVTNAPVVPPKHDTDQQDDSLEKQQVLEPSVNSNIPKKQTNQQLAVVTAPANSAPQTKTTAEISAGTELDTMPNVKHVDGKVYFYGDDGQPKKNFTTIIDGKPYYFDKDTGALSNNDKQYVSELFSIGNKHNAVYNTSSDNFTQLEGHLTASSWYRPKDILKNGKRWAPSTVTDFRPLLMAWWPDKSTQVTYLNYMKDQGLLSGTHHFSDNENMRTLTAAAMQAQVNIEKKIGQLGNTDWLKTAMTQYIDAQPNWNIDSEAKGDDHLQGGALLYTNSDMSPKANSDYRKLSRTPKNQKGQIADKYKQGGFELLLANDVDNSNPVVQAEQLNWLHYMMNIGSILQNDDQANFDGYRVDAVDNVDADLLQIAGEYAKAAYGVDKNDARANQHLSILEDWGDEDPDYVKAHGNQQITMDFPLHLAIKYALNMPNDKRSGLEPTREHSLVKRITDDKENVAQPNYSFIRAHDSEVQTIIADIIKDKINPASTGLDSTVTLDQIKQAFDIYNADELKADKVYTPYNIPASYALLLTNKDTIPRVYYGDMFTDDGQYMAKQSPYYQAIDALLKARIKYAAGGQTMKMNYFPDEQSVMTSVRYGKGAMTASDSGNQETRYQGIGLVVNNRPDLKLSDKDEVKMDMGAAHKNQDYRPVLLTTKSGLKVYSTDANAPVVRTDANGQLTFKADMVYGVNDPQVSGYIAAWVPVGASENQDARTKSETTQSTDGSVYHSNAALDSQVIYEGFSNFQDFPTTPDEFTNIKIAQNVNLFKDWGITSFEMAPQYRASSDKSFLDAIVQNGYAFTDRYDIGYNTPTKYGTADNLLDALRALHGQGIQAINDWVPDQIYNLPDEQLVTAIRTDGSGDHTYGSVIDHTLYASKTVGGGIYQQQYGGAFLEQLKTQYPQLFQQKQISTDQPMNPDIQIKSWEAKYFNGSNIQGRGAWYVLKDWGTQQYFNVSDAQTFLPKQLLGEKAKTGFVTRGKETSFYSTSGYQAKSAFICDNGNWYYFDDKGKMVVGNQVINGINYYFLPNGIELQDAYLVHDGMYYYYNNIGKQLHNTYYQDKQKNFHYFFEDGHMAQGIVTIIQSDGTPVTQYFDENGKQQKGVAVKGSDGHLHYFDGASGNMLFKSWGRLADGSWLYVDEKGNAVTGKQTINNQTVYFNDDGRQIKNNFKELADGSWLYLNNKGVAVTGEQIINGQTLYFGNDGRQFKGTTHINATGESRYYDPDSGNMITDRFERVGDNQWAYFGYDGVAVTGDRIIKGQKLYFNQNGIQMKGHLRLENGIMRYYDADTGELVRNRFVLLSDGSWVYFGQDGVPVTGVQVINGQTLYFDADGRQVKGQQRVIGNQRYWMDKDNGEMKKITYAAALEHHHHHH

SEQ ID NO: 3 - protein, 711 aa, Artificial Sequence
  CGTase CGT-SL
MKRWLSVVLSMSLVFSAFFLVSDTQKVTVEAAGNLNKVNFTSDIVYQIVVDRFVDGNTSNNPSGSLFSSGCTNLRKYCGGDWQGIINKINDGYLTEMGVTAIWISQPVENVFAVMNDADGSTSYHGYWARDFKKTNPFFGTLSDFQRLVDAAHAKGIKVIIDFAPNHTSPASETNPSYMENGRLYDNGTLIGGYTNDTNSYFHHNGGTTFSNLEDGIYRNLFDLADFNHQNQFIDKYLKDAIKLWLDMGIDGIRMDAVKHMPFGWQKSFMDEVYDYRPVFTFGEWFLSENEVDSNNHFFANESGMSLLDFRFGQKLRQVLRNNSDDWYGFNQMIQDTASAYDEVIDQVTFIDNHDMDRFMADEGDPRKVDIALAVLLTSRGVPNIYYGTEQYMTGNGDPNNRKMMTSFNKNTRAYQVIQKLSSLRRSNPALSYGDTEQRWINSDVYIYERQFGKDVVLVAVNRSLSKSYSITGLFTALPSGTYTDQLGALLDGNTIQVGSNGAVNAFNLGPGEVGVWTYSAAESVPIIGHIGPMMGQVGHKLTIDGEGFGTNVGTVKFGNTVASVVSWSNNQITVTVPNIPAGKYNITVQTSGGQVSAAYDNFEVLTNDQVSVRFVVNNANTNWGENIYLVGNVHELGNWNTSKAIGPLFNQVIYSYPTWYVDVSVPEGKTIEFKFIKKDGSGNVIWESGSNHVYTTPTSTTGTVNVNWQY

SEQ ID NO: 4 - protein, 496 aa, Artificial Sequence
  UGT73C3
MATEKTHQFHPSLHFVLFPFMAQGHMIPMIDIARLLAQRGVTITIVTTPHNAARFKNVLNRAIESGLAINILHVKFPYQEFGLPEGKENIDSLDSTELMVPFFKAVNLLEDPVMKLMEEMKPRPSCLISDWCLPYTSIIAKNFNIPKIVFHGMGCFNLLCMHVLRRNLEILENVKSDEEYFLVPSFPDRVEFTKLQLPVKANASGDWKEIMDEMVKAEYTSYGVIVNTFQELEPPYVKDYKEAMDGKVWSIGPVSLCNKAGADKAERGSKAAIDQDECLQWLDSKEEGSVLYVCLGSICNLPLSQLKELGLGLEESRRSFIWVIRGSEKYKELFEWMLESGFEERIKERGLLIKGWAPQVLILSHPSVGGFLTHCGWNSTLEGITSGIPLITWPLFGDQFCNQKLVVQVLKAGVSAGVEEVMKWGEEDKIGVLVDKEGVKKAVEELMGDSDDAKERRRRVKELGELAHKAVEKGGSSHSNITLLLQDIMQLAQFKN

SEQ ID NO: 5 - protein, 495 aa, Artificial Sequence
  UGT73C6
MAFEKNNEPFPLHFVLFPFMAQGHMIPMVDIARLLAQRGVLITIVTTPHNAARFKNVLNRAIESGLPINLVQVKFPYQEAGLQEGQENMDLLTTMEQITSFFKAVNLLKEPVQNLIEEMSPRPSCLISDMCLSYTSEIAKKFKIPKILFHGMGCFCLLCVNVLRKNREILDNLKSDKEYFIVPYFPDRVEFTRPQVPVETYVPAGWKEILEDMVEADKTSYGVIVNSFQELEPAYAKDFKEARSGKAWTIGPVSLCNKVGVDKAERGNKSDIDQDECLEWLDSKEPGSVLYVCLGSICNLPLSQLLELGLGLEESQRPFIWVIRGWEKYKELVEWFSESGFEDRIQDRGLLIKGWSPQMLILSHPSVGGFLTHCGWNSTLEGITAGLPMLTWPLFADQFCNEKLVVQILKVGVSAEVKEVMKWGEEEKIGVLVDKEGVKKAVEELMGESDDAKERRRRAKELGESAHKAVEEGGSSHSNITFLLQDIMQLAQSNN

SEQ ID NO: 6 - protein, 481 aa, Artificial Sequence
  rf85C2
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 7 - protein, 495 aa, Artificial Sequence
  UGT73C5
MVSETTKSSPLHFVLFPFMAQGHMIPMVDIARLLAQRGVIITIVTTPHNAARFKNVLNRAIESGLPINLVQVKFPYLEAGLQEGQENIDSLDTMERMIPFFKAVNFLEEPVQKLIEEMNPRPSCLISDFCLPYTSKIAKKFNIPKILFHGMGCFCLLCMHVLRKNREILDNLKSDKELFTVPDFPDRVEFTRTQVPVETYVPAGDWKDIFDGMVEANETSYGVIVNSFQELEPAYAKDYKEVRSGKAWTIGPVSLCNKVGADKAERGNKSDIDQDECLKWLDSKKHGSVLYVCLGSICNLPLSQLKELGLGLEESQRPFIWVIRGWEKYKELVEWFSESGFEDRIQDRGLLIKGWSPQMLILSHPSVGGFLTHCGWNSTLEGITAGLPLLTWPLFADQFCNEKLVVEVLKAGVRSGVEQPMKWGEEEKIGVLVDKEGVKKAVEELMGESDDAKERRRRAKELGDSAHKAVEEGGSSHSNISFLLQDIMELAEPNN

SEQ ID NO: 8 - protein, 495 aa, Artificial Sequence
  UGT73E1
MSPKMVAPPTNLHFVLFPLMAQGHLVPMVDIARILAQRGATVTIITTPYHANRVRPVISRAIATNLKIQLLELQLRSTEAGLPEGCESFDQLPSFEYWKNISTAIDLLQQPAEDLLRELSPPPDCIISDFLFPWTTDVARRLNIPRLVFNGPGCFYLLCIHVAITSNILGENEPVSSNTERVVLPGLPDRIEVTKLQIVGSSRPANVDEMGSWLRAVEAEKASFGIVVNTFEELEPEYVEEYKTVKDKKMWCIGPVSLCNKTGPDLAERGNKAAITEHNCLKWLDERKLGSVLYVCLGSLARISAAQAIELGLGLESINRPFIWCVRNETDELKTWFLDGFEERVRDRGLIVHGWAPQVLILSHPTIGGFLTHCGWNSTIESITAGVPMITWPFFADQFLNEAFIVEVLKIGVRIGVERACLFGEEDKVGVLVKKEDVKKAVECLMDEDEDGDQRRKRVIELAKMAKIAMAEGGSSYENVSSLIRDVTETVRAPH

SEQ ID NO: 9 - protein, 458 aa, Artificial Sequence
  UGT98
MDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFNTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDSDGKIQREEVAKSIKEVVIEKTREDVRKKAREMGEILRSKGDEKIDELVAEISLLRKKAPCSI

SEQ ID NO: 10 - DNA, 1434 bp, Artificial Sequence
  UGT1495 gene sequence
atgcttccatggctggctcacggccatgtctcccctttcttcgagctcgccaagttgctcgccgctagaaacttccacatattcttctgctccaccgccgtaaacctccgctccgtcgaaccaaaactctctcagaagctctcctcccacgtggagctggtggagctcaacctaccgccctcgccggagctccctccgcaccgccacaccaccgccggccttccaccgcacctcatgttctcgctcaagcgagctttcgacatggccgctcccgccttcgccgccatcctccgcgacctgaacccggacttgctcatctacgacttcctgcagccgtgggcggcggcggaggctctgtcggcggatattccggccgtgatgttcaaaagcacgggtgcgctcatggcggccatggtcgcgtacgagctgacgtttccgaactctgattttttctcgcttttccctgagattcgtctctccgagtgcgagattaaacagctgaagaacttgtttcaatgttctgtgaatgatgcgaaagacaagcaaaggattaagggatgttatgagagatcttgcggcatgattttggtgaaatctttcagagaaatcgaaggcaaatatattgattttctctctactctgctgggcaagaaggttgttccagttggtccacttgttcaacaaacagaagacgacgtcgtatcaggaagttttgacgaatggctaaatggaaaagatagatcgtcttccatactcgtgtctttcggaagcgagttctacctgtccagagaagacatggaagagatcgcgcatggcttagagctgagccaggtgaacttcatatgggtcgtcaggtttccggcgggaggagagagaaacacgacaaaggtggaagaagaactgccaaaagggtttctagagagagttagagagagagggatggtggtggagggctgggcgccgcaggctcagatcttgaaacatccaagcgtcggcggattcctcagccactgcgggtggagctccgtcgtggagagcatgaaattcggcgttccgatcatcgccatgccgatgcacctcgaccagccgctgaattcccggctggtcgagcggctcggcgtcggcgtagtggtggagagagacggccgcctccggggagaggtggagagagttgtcagagaggtggtggtggagaaaagtggagagagagtgaggaagaaggtggaggagtttgcagagatcatgaagaagaaaaaagacaatgaagagatggacgtagtcgtggaagagttggtgacgctctgcaggaagaagaagaaggaggaggatttacagagtaattattggtgcagaaccgccattgatgaccattgttctgaagtcgtgaagattgaagatgctgcagcagccgacgaggagcctctttgcaaataa

SEQ ID NO: 11 - DNA, 1383 bp, Artificial Sequence
  UGT1817 gene sequence
atggctgtcacttacagcctgcacatagcaatgtacccttggtttgctttcggccacttgactccatttctccaagtctccaacaagcttgccaaggaaggccacaaaatctccttcttcatcccaacgaaaacgctaaccaaattgcagcctttcaatctctttccagatctcattacctttgtccccatcactgttcctcatgttgatggtctccctcttggagctgagactactgctgatgtttctcacccttcacagctcagtctcatcatgactgctatggattgcacccaacccgaaatcgagtgtcttcttcgagacataaaacctgatgccatcttcttcgatttcgcgcactgggtgccaaaattggcatgtggattgggcattaagtcgattgattacagtgtctgttctgcagtatcaattggttatgttttgcccctattaaggaaagtttgtggacaagatttattaactgaagatgattttatgcagccatctcctggctacccgagttccaccatcaatcttcaagctcatgaggctcgatattttgcatctctgagccgctggaggtttggcagtgatgtccctttctttagtcgccatcttactgcacttaatgaatgcaatgctttagcattcaggtcatgtagggagattgaagggccttttatagactatccagaaagtgaattaaaaaagcctgtgttgctttccggagcagtggatctacaaccgccaaccacaactgtagaagaaagatgggcaaaatggctatcagggttcaacaccgactcggtcgtatattgtgcatttggaagtgagtgtaccttagcaaaagaccaattccaagaactgctgttgggttttgagctttcaaatatgccattctttgctgcacttaaaccaccttttggtgttgactcggttgaagcagccttgcctgaaggttttgaacagagagttcagggaagaggggtggtctatgggggatgggtccaacagcagctcattttggagcacccatcaattggatgctttgttacacattgtggatcaggctccttatcagaggcgttagtgaagaagtgtcaattagtgttgttacctcgtatcggtgaccactttttccgagcaagaatgttgagcaattatttgaaagttggtgtggaggtagagaaaggagaaggagatggatcttttacaaaggaaagtgtgtggaaggcagtgaagacagtgatggatgaagagaatgaaactgggaaagagttcagagcgaaccgtgccaagataagagagctattgctcgacgaagatctcgaggagtcttatatcaacaatttcatccacagcctgcatactttgaatgcatga

SEQ ID NO: 12 - DNA, 1347 bp, Artificial Sequence
  UGT5914
atggaagctaagaactgcaaaaaggttctgatgttcccatggctggcgcatggtcacatatcaccatttgtagagctggccaagaagctcacagacaacaacttcgccgtttttctatgttcttcccctgcaaatcttcaaaacgtcaagccaaaactcccccatcactactctgattccattgaactcgtggagctcaaccttccatcgtcgccggagcttccccctcatatgcacaccaccaatggcctccctttgcatttagttcccaccctcgttgacgccttggacatggccgctccgcacttctccgccattttacaggaactgaatccagattttctcatattcgacatcttccaaccctgggcggctgaaatcgcttcctccttcggcgttcctgctattttgttgcttatcgttggatctgctataaccgctttaggggttcattttgtccggagctccggtacggaattcccctttcccgagcttactaaatcattcaagaaggaggacgaccgaaaacctccaggagattccggcaacgatagaggaaaacggctattcaaatgtctgctggacctggaacattcttcagagactattttggtgaacagttttacagagatagagggcaaatatatggactatctctcggtcttactgaagaagaagatccttccgattggtcctttggttcagaaaattggctccgatgacgatgaatcgggaatcctccggtggcttgacaagaagaaaccgaattcaactgtgtacgtttcgttcgggagtgagtactatttgagcaaagaagacatagcagagcttgcgcatggtctggaaatcagcggcgtcaatttcatctggattgttcggtttccaaagggagagaaaatcgccattgaagaggcattaccagatgaatttcttgaaagagtcggagagagaggcgtcgtcgttgatggatgggcgccgcagatgaaaatattagggcattcgagcgtcggcgggtttctgtctcactgcggatggaactctgtgctggagagtctggtgctcggcgtgccgatcatatccctgccgatacacctcgaacagccgtggaacgccttggtagcggagcacgtcggcgtttgtgtgagggcgaagagagacgacggaggaaatcttcaaagagagttggtggcggaggccattaaagaagtggtggttgaggaaacaggagcggaactgagaagcaaagcaagagtaattagtgaaatcttgaaaaataaagaagctgaaacaatacaagatttggtggctgagcttcaccggctttctgacgcaagaagagcttgttga

SEQ ID NO: 13 - DNA, 1389 bp, Artificial Sequence
  UGT8468 gene sequence
atggaaaaaaatcttcacatagtgatgcttccatggtcggcgttcggccatctcataccattttttcacctctccatagccttagccaaagccaaagtttatatctccttcgtctccactccaagaaatattcagagactyccccaaatcccgccggacttagcttctttcatagatttggtggccattcccttgccgagactcgacgacgatctgttgctagaatctgcagaggccacttctgatattccgatcgacaagattcagtatttgaagcgagccgtcgacctcctccgccaccccttcaagaagtttgtcgccgaacaatcgccggactgggtcgtcgttgattttcatgcttattgggccggcgagatctaccaggagtttcaagttcccgtcgcctacttctgtattttctcggccatctgtttgctttatcttggacctccagacgtgtattcgaaggatcctcagatcatggcacgaatatctcccgttaccatgacggtgccgccggagtgggtcggttttccgtccgccgtagcctacaacttgcatgaggcgacggtcatgtactctgctctctatgaaacaaatgggtctggaataagcgactgcgagaggattcgccggctcgtcctttcctgtcaagccgtggccattcgaagctgcgaggagattgaaggcgaataccttaggttatgtaagaaactgattccaccgcaggggattgccgtcggcttgcttccgccggaaaagccaccaaaatcagatcacgagctcatcaaatggcttgacgagcaaaagctccgattcgtcgtgtacgtgacattcggcagcgaatgcaacctgacgaaggaccaagttcacgagatagcccacgggctggaactgtcggagctgccatttttatgggcactgaggaaacccagctgggcagctgaggaagacgatgggctgccgtctgggtttcgtgagagaacgtccgggagaggggtggtgagcatggagtgggtgccgcagttggagattctggcgcaccaggccatcggcgtctctttagttcacgggggctggggctctattatcgagtcgctacaagctgggcactgtctggttgtgctgccgtttatcatcgaccagccgctgaactcaaagcttttggtggagaaagggatggcgcttgagatcagaaggaacggttctgatggatggtttagtagagaagacatcgccggaactttgagagaagctatgcggtcgtctgaggaaggcgggcagctgaggagccgtgcaaaagaggcggcggccatcgttggagatgagaagctgcagtgggaacaatacttcggcgcgttcgtacagtttctgagggacaagtcttga

SEQ ID NO: 14 - DNA, 1395 bp, Artificial Sequence
  UGT10391 gene sequence
atgtccgaggagaaaggcagagggcacagctcgtcgacggagagacacactgctgccgccatgaacgccgagaaacgaagcaccaaaatcttgatgctcccatggctggctcacggccacatatctccatacttcgagctcgccaagaggctcaccaagaaaaactgccacgtttacttgtgttcttcgcctgtaaatctccaaggcatcaagccgaaactctctgaaaattactcttcctccattgaacttgtggagcttcatcttccatctctccccgaccttcctccccatatgcacacgaccaaaggcatccctctacatctacaatccaccctcatcaaagccttcgacatggccgcccctgatttttccgacctgttgcagaaactcgagccggatctcgtcatttccgatctcttccagccatgggcagttcaattagcgtcgtctcggaacattcccgtcgtcaatttcgttgtcaccggagtcgctgttcttagtcgtttggctcacgtgttttgcaactccgttaaggaattccctttcccggaactcgatctaaccgaccattggatctccaagagccgccgcaaaacgtccgacgaattaggtcgcgagtgcgcgatgcgatttttcaactgcatgaaacaatcttcaaacatcactctagccaacactttccccgagttcgaagaaaaatacatcgattatctctcttcctcgtttaagaaaaagattcttccggttgctcctctagttcctgaaatcgacgcagacgacgagaaatcggaaattatcgagtggcttgacaagaagaaaccgaaatcgactgtttacgtttcgtttgggagtgagtattatctgacgaaagaagacagggaagagctcgcccatggcttagaaaagagcggcgtgaatttcatctgggttattaggtttccaaagggcgagaagatcaccattgaagaggctttaccagaaggatttctcgagagagtaggggacaggggagtgattatcgacgggtgggcgccgcagttgaaaatattgaggcattcaagcgtgggcgggttcgtgtgccactgcgggtggaactctgtggtggagagcgtggtgtttggggtgccgatcatagccttgccgatgcagctcgatcagccatggcatgcgaaggtggcggaggacggcggcgtctgtgcggaggcgaagagagacgttgaagggagcgttcagagagaagaggtggcgaaggccattaaagaggtggtgtttgagaagaaggggggggttctgagtggaaaagcaagagagatcagcgaggccttgagaaagagggaaggggaaatcatagaggaattggttgctgagtttcaccagctctgtgaagcttga

SEQ ID NO: 15 - protein, 496 aa, Artificial Sequence
  UGT1576 amino acid sequence
MASPRHTPHFLLFPFMAQGHMIPMIDLARLLAQRGVIITIITTPHNAARYHSVLARAIDSGLHIHVLQLQFPCKEGGLPEGCENVDLLPSLASIPRFYRAASDLLYEPSEKLFEELIPRPTCIISDMCLPWTMRIALKYHVPRLVFYSLSCFFLLCMRSLKNNLALISSKSDSEFVTFSDLPDPVEFLKSELPKSTDEDLVKFSYEMGEADRQSYGVILNLFEEMEPKYLAEYEKERESPERVWCVGPVSLCNDNKLDKAERGNKASIDEYKCIRWLDGQQPSSVVYVSLGSLCNLVTAQIIELGLGLEASKKPFIWVIRRGNITEELQKWLVEYDFEEKIKGRGLVILGWAPQVLILSHPAIGCFLTHCGWNSSIEGISAGVPMVTWPLFADQVFNEKLIVQILRIGVSVGTETTMNWGEEEEKGVVVKREKVREAIEIVMDGDEREERRERCKELAETAKRAIEEGGSSHRNLTMLIEDIIHGGGLSYEKGSCR

SEQ ID NO: 16 - protein, 459 aa, Artificial Sequence
  UGT SK98
MDAQRGHTTTILMLPWVGYGHLLPFLELAKSLSRRKLFHIYFCSTSVSLDAIKPKLPPSISSDDSIQLVELRLPSSPELPPHLHTTNGLPSHLMPALHQAFVMAAQHFQVILQTLAPHLLIYDILQPWAPQVASSLNIPAINFSTTGASMLSRTLHPTHYPSSKFPISEFVLHNHWRAMYTTADGALTEEGHKIEETLANCLHTSCGVVLVNSFRELETKYIDYLSVLLNKKVVPVGPLVYEPNQEGEDEGYSSIKNWLDKKEPSSTVFVSFGTEYFPSKEEMEEIAYGLELSEVNFIWVLRFPQGDSTSTIEDALPKGFLERAGERAMVVKGWAPQAKILKHWSTGGLVSHCGWNSMMEGMMFGVPIIAVPMHLDQPFNAGLLEEAGVGVEAKRGSDGKIQREEVAKSIKEVVIEKTREDVRKKAREMGEILRSKGDEKIDELVAEISLLRKKAPCSI

SEQ ID NO: 17 - protein, 469 aa, Artificial Sequence
  UGT430 amino acid sequence
MEQAHDLLHVLLFPYPAKGHIKPFLCLAELLCNAGLNVTFLNTDYNHRRLHNLHLLAACFPSLHFESISDGLQPDQPRDILDPKFYISICQVTKPLFRELLLSYKRTSSVQTGRPPITCVITDVIFRFPIDVAEELDIPVFSFCTFSARFMFLYFWIPKLIEDGQLPYPNGNINQKLYGVAPEAEGLLRCKDLPGHWAFADELKDDQLNFVDQTTASLRSSGLILNTFDDLEAPFLGRLSTIFKKIYAVGPIHALLNSHHCGLWKEDHSCLAWLDSRAARSVVFVSFGSLVKITSRQLMEFWHGLLNSGTSFLFVLRSDVVEGDGEKQVVKEIYETKAEGKWLVVGWAPQEKVLAHEAVGGFLTHSGWNSILESIAAGVPMISCPKIGDQSSNCTWISKVWKIGLEMEDQYDRATVEAMVRSIMKHEGEKIQKTIAELAKRAKYKVSKDGTSYRNLEILIEDIKKIKPN

SEQ ID NO: 18 - protein, 474 aa, Artificial Sequence
  UGT1697
MVQPRVLLFPFPALGHVKPFLSLAELLSDAGIDVVFLSTEYNHRRISNTEALASRFPTLHFETIPDGLPPNESRALADGPLYFSMREGTKPRFRQLIQSLNDGRWPITCIITDIMLSSPIEVAEEFGIPVIAFCPCSARYLSIHFFIPKLVEEGQIPYADDDPIGEIQGVPLFEGLLRRNHLPGSWSDKSADISFSHGLINQTLAAGRASALILNTFDELEAPFLTHLSSIFNKIYTIGPLHALSKSRLGDSSSSASALSGFWKEDRACMSWLDCQPPRSVVFVSFGSTMKMKADELREFWYGLVSSGKPFLCVLRSDVVSGGEAAELIEQMAEEEGAGGKLGMVVEWAAQEKVLSHPAVGGFLTHCGWNSTVESIAAGVPMMCWPILGDQPSNATWIDRVWKIGVERNNREWDRLTVEKMVRALMEGQKRVEIQRSMEKLSKLANEKVVRGGLSFDNLEVLVEDIKKLKPYKF

SEQ ID NO: 19 - protein, 452 aa, Artificial Sequence
  UGT11789
MDAKEESLKVFMLPWLAHGHISPYLELAKRLAKRKFLVYFCSTPVNLEAIKPKLSKSYSDSIQLMEVPLESTPELPPHYHTAKGLPPHLMPKLMNAFKMVAPNLESILKTLNPDLLIVDILLPWMLPLASSLKIPMVFFTIFGAMAISFMIYNRTVSNELPFPEFELHECWKSKCPYLFKDQAESQSFLEYLDQSSGVILIKTSREIEAKYVDFLTSSFTKKVVTTGPLVQQPSSGEDEKQYSDIIEWLDKKEPLSTVLVSFGSEYYLSKEEMEEIAYGLESASEVNFIWIVRFPMGQETEVEAALPEGFIQRAGERGKVVEGWAPQAKILAHPSTGGHVSHNGWSSIVECLMSGVPVIGAPMQLDGPIVARLVEEIGVGLEIKRDEEGRITRGEVADAIKTVAVGKTGEDFRRKAKKISSILKMKDEEEVDTLAMELVRLCQMKRGQESQD

SEQ ID NO: 20 - protein, 520 aa, Artificial Sequence
  CYP1798 amino acid sequence
MEMSSSVAATISIWMVVVCIVGVGWRVVNWVWLRPKKLEKRLREQGLAGNSYRLLFGDLKERAAMEEQANSKPINFSHDIGPRVFPSMYKTIQNYGKNSYMWLGPYPRVHIMDPQQLKTVFTLVYDIQKPNLNPLIKFLLDGIVTHEGEKWAKHRKIINPAFHLEKLKDMIPAFFHSCNEIVNEWERLISKEGSCELDVMPYLQNLAADAISRTAFGSSYEEGKMIFQLLKELTDLVVKVAFGVYIPGWRFLPTKSNNKMKEINRKIKSLLLGIINKRQKAMEEGEAGQSDLLGILMESNSNEIQGEGNNKEDGMSIEDVIEECKVFYIGGQETTARLLIWTMILLSSHTEWQERARTEVLKVFGNKKPDFDGLSRLKVVTMILNEVLRLYPPASMLTRIIQKETRVGKLTLPAGVILIMPIILIHRDHDLWGEDANEFKPERFSKGVSKAAKVQPAFFPFGWGPRICMGQNFAMIEAKMALSLILQRFSFELSSSYVHAPTVVFTTQPQHGAHIVLRKL

SEQ ID NO: 21 - protein, 313 aa, Artificial Sequence
  EPH1 epoxide hydrolase
MEKIEHSTIATNGINMHVASAGSGPAVLFLHGFPELWYSWRHQLLYLSSLGYRAIAPDLRGFGDTDAPPSPSSYTAHHIVGDLVGLLDQLGVDQVFLVGDWGAMMAWYFCLFRPDRVKALVNLSVHFTPRNPAISPLDGFRLMLGDDFYVCKFQEPGVAEADFGSVDTATMFKKFLTMRDPRPPIIPNGFRSLATPEALPSWLTEEDIDYFAAKFAKTGFTGGFNYYRAIDLTWELTAPWSGSEIKVPTKFIVGDLDLVYHFPGVKEYIHGGGFKKDVPFLEEVVVMEGAAHFINQEKADEINSLIYDFIKQF

SEQ ID NO: 22 - protein, 316 aa, Artificial Sequence
  EPH2 epoxide hydrolase
MEKIEHTTISTNGINMHVASIGSGPAVLFLHGFPELWYSWRHQLLFLSSMGYRAIAPDLRGFGDTDAPPSPSSYTAHHIVGDLVGLLDQLGIDQVFLVGHDWGAMMAWYFCLFRPDRVKALVNLSVHFLRRHPSIKFVDGFRALLGDDFYFCQFQEPGVAEADFGSVDVATMLKKFLTMRDPRPPMIPKEKGFRALETPDPLPAWLTEEDIDYFAGKFRKTGFTGGFNYYRAFNLTWELTAPWSGSEIKVAAKFIVGDLDLVYHFPGAKEYIHGGGFKKDVPLLEEVVVVDGAAHFINQERPAEISSLIYDFIKKF

SEQ ID NO: 23 - protein, 316 aa, Artificial Sequence
  EPH3 epoxide hydrolase
MDQIEHITINTNGIKMHIASVGTGPVVLLLHGFPELWYSWRHQLLYLSSVGYRAIAPDLRGYGDTDSPASPTSYTALHIVGDLVGALDELGIEKVFLVGHDWGAIIAWYFCLFRPDRIKALVNLSVQFIPRNPAIPFIEGFRTAFGDDFYMCRFQVPGEAEEDFASIDTAQLFKTSLCNRSSAPPCLPKEIGFRAIPPPENLPSWLTEEDINYYAAKFKQTGFTGALNYYRAFDLTWELTAPWTGAQIQVPVKFIVGDSDLTYHFPGAKEYIHNGGFKKDVPLLEEVVVVKDACHFINQERPQEINAHIHDFINKF

SEQ ID NO: 24 - protein, 316 aa, Artificial Sequence
  EPH4 epoxide hydrolase
MENIEHTTVQTNGIKMHVAAIGTGPPVLLLHGFPELWYSWRHQLLYLSSAGYRAIAPDLRGYGDTDAPPSPSSYTALHIVGDLVGLLDVLGIEKVFLIGHDWGAIIAWYFCLFRPDRIKALVNLSVQFFPRNPTTPFVKGFRAVLGDQFYMVRFQEPGKAEEEFASVDIREFFKNVLSNRDPQAPYLPNEVKFEGVPPPALAPWLTPEDIDVYADKFAETGFTGGLNYYRAFDRTWELTAPWTGARIGVPVKFIVGDLDLTYHFPGAQKYIHGEGFKKAVPGLEEVVVMEDTSHFINQERPHEINSHIHDFFSKFC

SEQ ID NO: 25 - protein, 325 aa, Artificial Sequence
  EPH5 epoxide hydrolase
MEKESEIHSIRHTTVSVNGINMHVAEKGEGPLVLFIHGFPELWYSWRHQILDLASLGYRAVAPDLRGYGDSDAPPSASSYTSFHIVGDLIALLDAIVGVEEKVFVVAHDWGAIIAWYLCLYRPDRIKALVNLSVAFIRRNPKGKPVEWIRALYGDDHYMCRCQEPGEIEGEFAEIGTERVLTQFLTYHSPKPLMLPKGKAFGHPLDTPIPLPPWLSHQDIEYYASKFDKKGFTGPVNYYRNLDRNWELNAPFTRAQVKVPVKFIVGDLDLTYHSFGTKEYIHSGEMKKDVPFLQEVVVMEGVGHFIQSEKPHEISDHIYQFIKKF

SEQ ID NO: 26 - protein, 316 aa, Artificial Sequence
  EPH6 epoxide hydrolase
MEKIEHTIITTNGINMHVASIGTGPAVLFLHGFPELWYSWRHQLLSFSSLGYRAIAPDLRGYGDSDAPPSPSSYTVFHIVGDLVGLLDQLGIDQVFLVGHDWGASIAWYFSLLRPDRIKALVNLSVQYFPRNPARNTVEALRALFGDDYYVCRFQEPGEMEEDFASIDTAVIFKIFLSSRDPRPPCIPKAVGFRAFPVPDSLPSWLSEEDISYYASKFSKKGFTGGLNYYRALALNWELTAPWTGTQIKVPTKFIVGDLDLTYHIPGSKEYIHKGGFERDVPSLEEVVVIEGAAHFVNQERPEEISKHIYDFIKKF

SEQ ID NO: 27 - protein, 316 aa, Artificial Sequence
  EPH7 epoxide hydrolase
MDAIEHRTVSVNGINMHVAEKGEGPVVLLLHGFPELWYSWRHQILALSSLGYRAVAPDLRGYGDTDAPGSISSYTCFHIVGLVALVESLGVDRVFVVAHDWGAMIAWCLCLFRPEMVKAFVCLSVPFRQRNPKMKPVQSMRAFFGDDYYICRFQNPGEIEEEMAQVGAREVLRGILTSRRPGPPILPKGQAFRARPGASTALPSWLSEKDLSFFASKYDQKGFTGPLNYYRAMDLNWELTASWTGVQVKVPVKYIVGDVDMVFTTPGVKEYVNGGGFKKDVPFLQEVVIMEGVGHFINQEKPEEISSHIHDFISRF

SEQ ID NO: 28 - protein, 311 aa, Artificial Sequence
  EPH8 epoxide hydrolase
MDQIQHKFIDIRGLKLHIAEIGTGSPAVVFLHGFPEIWYSWRHQMVAAAAVGYRAISPDLRGYGFSDPHPQPQNASFDDFVEDTLAILDFLHIPKAFLVGKDFGSWPVYLFSLVHPTRVAGIVSLGVPFLPPNPKRYRDLPEGFYIFRWKESGRAEADFGRFDVKTVLRRIYTLFSRSEIPIAEKDQEIMDMVDESTPPPPWLTDEDLAAYATAYEHSGFESALQVPYRRRHQELGMSNPRVDVPVLLIIGGKDYFLKFPGIEDYIKSEKMREIVPDLEVADLADGTHFMQEQFPAQVNHLLISFLGKRNT

SEQ ID NO: 29 - protein, 317 aa, Artificial Sequence
  EH1 epoxide hydrolase 1
MDAIEHRTVSVNGINMHVAEKGEGPVVLLLHGFPELWYSWRHQILALSSLGYRAVAPDLRGYGDTDAPGSISSYTCFHIVGDLVALVESLGMDRVFVVAHDWGAMIAWCLCLFRPEMVKAFVCLSVPFRQRNPKMKPVQSMRAFFGDDYYICRFQNPGEIEEEMAQVGAREVLRGILTSRRPGPPILPKGQAFRARPGASTALPSWLSEKDLSFFASKYDQKGFTGPLNYYRAMDLNWELTASWTGVQVKVPVKYIVGDVDMVFTTPGVKEYVNGGGFKKDVPFLQEVVIMEGVGHFINQEKPEEISSHIHDFISKF

SEQ ID NO: 30 - protein, 316 aa, Artificial Sequence
  EH2 epoxide hydrolase
MDEIEHITINTNGIKMHIASVGTGPVVLLLHGFPELWYSWRHQLLYLSSVGYRAIAPDLRGYGDTDSPASPTSYTALHIVGDLVGALDELGIEKVFLVGHDWGAIIAWYFCLFRPDRIKALVNLSVQFIPRNPAIPFIEGFRTAFGDDFYICRFQVPGEAEEDFASIDTAQLFKTSLCNRSSAPPCLPKEIGFRAIPPPENLPSWLTEEDINFYAAKFKQTGFTGALNYYRAFDLTWELTAPWTGAQIQVPVKFIVGDSDLTYHFPGAKEYIHNGGFKRDVPLLEEVVVVKDACHFINQERPQEINAHIHDFINKF

SEQ ID NO: 31 - DNA, 1572 bp, Artificial Sequence
  CYP533 (sequence) 3
atggaactcttctctaccaaaactgcagccgagatcatcgctgttgtcttgtttttctacgctctcatccggctattatctggaagattcagctctcaacagaagagactgccacctgaagccggtggcgcctggccactgatcggccatctccatctcctaggtgggtcggaacctgcacataaaaccttggcgaacatggcggacgcctacggaccagtttttacgttgaaactgggcatgcatacagctttggttatgagcagttgggaaatagcgagagagtgctttactaaaaacgacagaatctttgcctcccgccccatagtcactgcctcaaagcttctcacctataaccataccatgtttgggttcagccaatatggtccattctggcgccatatgcgcaaaatagccacgcttcaactcctctcaaaccaccgcctcgagcagctccaacacatcagaatatcggaggtccagacttcgattaagaaactgtacgagttgtgggtcaacagcagaaataatggaggcgagaaagtgttggtggagatgaagacgtggttcggaggcataaccttgaacaccatattcaggatggtggtcggaaagcgattctcgactgctttcgaaggcagtggtggcgaacggtatcggaaggcgttgagggattctcttgaatggtttggggcattcgttccgtcagattcattcccgtttttaagatggttggatttgggaggatatgagaaggcgatgaagaagacggcgagtgtgctggacgaggtgcttgataaatggctcaaagagcatcagcagaggagaaactccggtgaactggagacggaggagcacgacttcatgcacgtgatgctgtctattgttaaggatgatgaagaactatccggctacgatgccgatacagtcacaaaagctacatgtttgaatttaatagttggtggattcgacactacacaagtaactatgacatgggctctttctttgcttctcaacaatgaagaggtattaaaaaaggcccaacttgaactagacgaacaagttggaagagagaggtttgtggaagagtccgatgttaaaaatctgttatatctccaggccatcgtgaaggaaactttgcgtttgtacccttcagcgccaatctcgacatttcatgaggccatggaagattgcactgtttctggctaccacatcttttcagggacgcgtttgatggtgaatcttcaaaagcttcaaagagatccacttgcatgggaggatccatgtgactttcgaccggagagatttctgacaactcataaggatttcgatcttagaggacatagtcctcaattgataccatttgggagtggtcgaagaatatgccctggcatctcgtttgccattcaagttttgcatcttacgcttgcaaatctacttcatgggtttgacattggaaggccatctcatgaaccaatcgatatgcaggagagtaaaggactaacgagtattaaaacaactccacttgaggttgttttagctccacgccttgctgctcaagtttatgagtga

SEQ ID NO: 32 - DNA, 1497 bp, Artificial Sequence
  Nucleotide sequence encoding CYP937 4
atgccgatcgcagaaggtgcagtctctgatttgtttggtcgcccactcttctttgcactatatgattggttcttagagcatggatctgtttataaacttgcctttggaccaaaagcctttgttgttgtatcagatcccattgtggcaagatatattcttcgagaaaatgcatttggttatgacaagggagtgcttgctgatattttagaaccgataatgggtaaaggactaataccagctgaccttggcacttggaagcagaggagacgagttattgctccaggattccatgccttgtacttggaagctatgaccaaagtatttgccaattgttcagaacgatcaatattgaaattggagaagcttctaggagaaggtgaactacaggagaataaaaccattgagttggatatggaagcagagttttcaagtttggctcttgatatcattggactcggtgttttcaactatgattttggttctgtaaccaaagaatctccggtgattaaggctgtatatgggactctttttgaagcagagcatagatcgactttctatatcccatattggaaagtacctttggcaaggtggatagtcccaaggcagcgtaaattccatggtgaccttaaggttattaatgagtgtcttgatggcctaatacgcaacgcaagagaaacccgagacgaaacggatgttgagaaattgcagcaaagggactacttaaatctcaaggatgccagtcttttgcgtttcttagttgatatgcggggagctgatgttgatgatcgccagcttagggacgatctgatgacgatgcttattgctggccatgaaacaactgctgctgtgcttacatgggctgtttttttgcttgcacaaaatccttcaaaaatgaaaaaagcgcaagcagagattgatttggttcttggcatggggaggccaacttttgaatcatttaaagcattgaagtacatcagacttatcgttgcagagactcttcgtttgtttcctcagcctccattgctgataagacgagctctcaaatcagatatattaccaggaggatacaatggtgacaaaactggatatgcaattcctgcagggactgacatcttcatctctgtttacaatctccacagatctccctacttctgggataatcctcaagaatttgaaccagagagatttcaagtaaagagggcaagcgagggaattgaaggatgggatggtttcgacccatctagaagccctggagctctatacccgaatgagattgtagcagacttttccttcttaccatttggtggaggccctagaaaatgtgtgggagatcaatttgctctaatggagtcaactatagcattggccatgttactgcagaagtttgatgtggagctaaaaggaagtccagaatctgtagaactagttactggagccacaatacataccaaaagtgggttgtggtgcaaactgagaagaagatcacaagtaaactga

SEQ ID NO: 33 - DNA, 1563 bp, Artificial Sequence
  Codon-optimized DNA sequence encoding CYP17985
atggaaatgtcctcaagtgtcgcagccacaatcagtatctggatggtcgtcgtatgtatcgtaggtgtaggttggagagtcgtaaattgggtttggttgagaccaaagaaattggaaaagagattgagagaacaaggtttggccggtaattcttacagattgttgttcggtgacttgaaggaaagagctgcaatggaagaacaagcaaattcaaagcctataaacttctcccatgacatcggtccaagagttttcccttcaatgtacaagaccatccaaaactacggtaaaaactcctacatgtggttaggtccataccctagagtccacatcatggatccacaacaattgaagaccgtttttactttggtctacgacattcaaaagccaaatttgaaccctttgattaaattcttgttagatggtatcgttacacatgaaggtgaaaagtgggctaagcacagaaagattattaacccagcattccatttggaaaagttgaaggatatgatacctgctttctttcactcatgtaatgaaatcgtcaacgaatgggaaagattgatttcaaaagaaggttcctgcgaattggatgtaatgccttatttgcaaaatttggccgctgacgccatttcaagaaccgcttttggttcttcatacgaagaaggtaaaatgatcttccaattgttgaaggaattgactgatttggttgtcaaggtagcttttggtgtttatattccaggttggagattcttgcctacaaagagtaacaacaaaatgaaggaaattaatagaaaaatcaagtctttgttgttgggtatcattaacaagagacaaaaggcaatggaagaaggtgaagccggtcaatctgatttgttgggtatattaatggaaagtaattctaacgaaatccaaggtgaaggtaataacaaggaagatggcatgtctattgaagacgtcatcgaagagtgtaaggtattttatataggtggtcaagaaactacagcaagattattgatctggactatgatattgttgtccagtcatacagaatggcaagaaagagccagaaccgaagtcttgaaggtatttggtaataagaaaccagatttcgacggtttgtcaagattgaaggtagttactatgatcttgaacgaagttttaagattgtacccacctgcttccatgttgacaagaatcatccaaaaggaaacaagagttggtaaattaaccttgccagcaggtgttatcttgataatgcctatcatcttgatacatagagatcacgacttgtggggtgaagatgctaacgagtttaaaccagaaagattcagtaaaggtgtttctaaggcagccaaagtccaaccagcctttttcccttttggttggggtcctagaatttgcatgggtcaaaacttcgctatgatcgaagctaagatggcattgagtttgatcttgcaaagattttctttcgaattgtcttcatcctacgttcatgcaccaactgtcgtcttcactacacaaccacaacacggtgcccacatcgttttgagaaagttatga

SEQ ID NO: 34 - DNA, 1602 bp, Artificial Sequence
  Nucleotide sequence encoding CYP1994
atggaaccacaaccaagtgcggaattcaactggaatcacagcctaagcaccgtcgctatcggtgtcattgccattattttcttccgttttctcgtcaaaagagtcaccggcgccggtgagcgaaagggtccgaagccgccaaaagtagccggagggtggcctctaattggccacctccctctcctcggaggacctgaactgccccatgtcaaactgggtggtttggctgataaatatggtccaatcttctcgatccggctgggtgtccactccgccgtcgtgataaacagttgggaggcggcgaaacagttattaaccaaccatgacgtcgccgtctcttcccgcccccaaatgctcggcggaaaactcctgggctacaactacgccgtgtttggtttcggaccctacggctcttactggcgcaacatgcgcaagataaccacgcaagagcttctatccaatagcagaatccagctcctaagagacgttcgagcgtcagaagtgaaccaaggcataaaagagctctaccagcactggaaagaaagaagagacggtcacgaccaagccttggtggaactgcagcagtgggtcggggacttgactatgaatctgattctcggagtcatcgccgggaaaaggttctttggagctgcagcaacggtagacgaggaagaggcgcgacggagccataaagcattgaaggagttgttacattatatggggctttttctactgggtgatgctgttccatatctaggatggttggacgtcggcggccatgtgaaggcgatgaagaaaacttcaaaagaattggaccgtatgttaacacagtggttggaggagcacaagaaggaaggacccaagaaagatcataaagacttcatggacgtgatgctttcagttctcaatgaaacatccgatgttctttcagataagacccatggcttcgatgctgataccatcatcaaagctacatgtatgacgatggttttaggagggagtgatacgacggcggtggttgtgatatgggcaatctcgctgctgctgaataatcgccctgcgttgagaaaagtgcaagaagaactggaagcccatatcggccgagacagagaactggaggaatcggatctcggtaagctagtgtatttgcaggcagtcgtgaaggagacattgcggctgtacggagccggaggccttttctttcgtgaaaccacagaggatgtcaccatcgacggattccatgtcgagaaagggacatggctgttcgtgaacgtggggaagatccacagagatgggaaggtgtggccggagccaacggagttcaaaccggagaggtttctgacgacccacaaagattttgatctgaagggccagcggtttgagctcatccctttcgggggaggaagaagatcgtgccctggaatgtcttttgggctccaaatgctacagcttattttgggtaaactgcttcaggcttttgatatatcgacgccgggggacgccgccgttgatatgaccggatccattggactgacgaacatgaaagccactccattggaagtgctcatcaccccgcgcttgcctctttcgctttacgattga

SEQ ID NO: 35 - DNA, 1236 bp, Artificial Sequence
  Nucleotide sequence encoding CYP20487
atggagactcttcttcttcatcttcaatcgttatttcatccaatttccttcactggtttcgttgtcctctttagcttcctgttcctgctccagaaatggttactgacacgtccaaactcttcatcagaagcctcacccccttctccaccaaagcttcccatcttcggacaccttctaaacctgggtctgcatccccacatcaccctcggagcctacgctcgccgctatggccctctcttcctcctccacttcggcagcaagcccaccatcgtcgtctcttctgccgaaatcgctcgcgatatcatgaagacccacgacctcgtcttcgccaaccgtcctaaatcaagcatcagcgaaaagattctttacggctccaaagatttagccgcatctccttacggcgaatactggaggcagatgaaaagcgttggcgtgcttcatcttttgagcaacaaaagggttcaatcctttcgctctgtcagagaagaagaagtcgaactgatgatccagaagatccaacagaaccccctatcagttaatttaagcgaaatattctctggactgacgaacgacatagtttgcagggtggctttagggagaaagtatggcgtgggagaagacggaaagaagttccggtctcttctgctggagtttggggaagtattgggaagtttcagtacgagagacttcatcccgtggctgggttggattgatcgtatcagtgggctggacgccaaagccgagagggtagccaaagagctcgatgctttctttgacagagtgatcgaagatcacatccatctaaacaagagagagaataatcccgatgagcagaaggacttggtggatgtgctgctttgtgtacagagagaagactccatcgggtttccccttgagatggatagcataaaagctttaatcttggacatgtttgctgcaggcacagacacgacatacacggtgttggagtgggcaatgtcccaactgttgagacacccagaagcgatgaagaaactgcagagggaggtcagagaaatagcaggtgagaaagaacacgtaagtgaggatgatttagaaaagatgcattacttgaaggcagtaatcaaagaaacgctgcggctacacccaccaatcccactcctcgtccccagagaatcaacccaagacatcaggttgagggggtacgatatcagaggcggcacccgggttatgatcaatgcatgggccatcggaaga

SEQ ID NO: 36 - DNA, 1614 bp, Artificial Sequence
  Nucleotide sequence encoding CYP27408
atgtcgatgagtagtgaaattgaaagcctctgggttttcgcgctggcttctaaatgctctgctttaactaaagaaaacatcctctggtctttactcttctttttcctaatctgggtttctgtttccattctccactgggcccatccgggcggcccggcttggggccgctactggtggcgccgccgccgcagcaattccaccgccgctgctattcccggcccgagaggcctccccctcgtcggcagcatgggcttgatggccgacttggcccaccaccggattgccgccgtggctgactccttaaacgccacccgcctcatggccttttcgctcggcgacactcgcgtgatcgtcacatgcaaccccgacgtcgccaaagagattctcaacagctccctcttcgccgaccgccccgttaaggagtccgcttactccttgatgttcaaccgcgccattgggttcgccccctatggcctttactggcggaccctccgccgcatcgcttcccaccacctcttctgccccaagcaaatcaagtcctcccagtcccagcgccgccaaatcgcttcccaaatggtcgcaatgttcgcaaaccgcgatgccacacagagcctctgcgttcgcgactctctcaagcgggcttctctcaacaacatgatgggctctgttttcggccgagtttacgacctctctgactcggctaacaatgacgtccaagaactccagagcctcgtcgacgaaggctacgacttgctgggcctcctcaactggtccgaccatctcccatggctcgccgacttcgactctcagaaaatccggttcagatgctcccgactcgtccccaaggtgaaccacttcgtcggccggatcatcgccgaacaccgcgccaaatccgacaaccaagtcctagatttcgtcgacgttttgctctctctccaagaagccgacaaactctctgactccgatatgatcgccgttctttgggaaatgatttttcgtgggacggacacggtggcagttttaatcgagtggatactggccaggatggtacttcacaacgatatccaaaggaaagttcaagaggagctagataacgtggttgggagtacacgcgccgtcgcggaatccgacattccgtcgctggtgtatctaacggctgtggttaaggaagttctgaggttacatccgccgggcccactcctgtcgtgggcccgcctagccatcactgatacaatcatcgatgggcatcacgtgccccgggggaccaccgctatggttaacatgtggtcgatagcgcgggacccacaggtctggtcggacccactcgaatttatgccccagaggtttgtgtccgaccccggtgacgtggagttctcggtcatgggttcggatctccggctggctccgttcgggtcgggcagaaggacctgccccgggaaggccttcgcctggacaactgtcaccttctgggtggccacgcttttacacgacttcaaatggtcgccgtccgatcaaaacgacgccgtcgacttgtcggaggtcctcaagctctcctgcgagatggccaatcccctcaccgttaaagtacacccaaggcgcagtttaagcttttaa

SEQ ID NO: 37 - DNA, 1506 bp, Artificial Sequence
  Nucleotide sequence encoding CYP34049
atggatggttttcttccaacagtggcggcgagcgtgcctgtgggagtgggtgcaatattgttcacggcgttgtgcgtcgtcgtgggaggggttttggtttatttctatggaccttactggggagtgagaagggtgcctggtccaccagctattccactggtcggacatcttcccttgctggctaagtacggcccagacgttttctctgtccttgccacccaatatggccctatcttcaggttccatatgggtaggcagccattgataattatagcagaccctgagctttgtaaagaagctggtattaagaaattcaaggacatcccaaatagaagtgtcccttctccaatatcagcttcccctcttcatcagaagggtcttttcttcacaagggatgcaagatggtcgacaatgcggaacacgatattatcggtctatcagtcctcccatctagcgagactaatacctactatgcaatcaatcattgaaactgcaactcaaaatctccattcctctgtccaggaagacatccctttctccaatctctccctcaaattgaccaccgatgtgattggaacagcagccttcggtgtcaactttgggctctctaatccacaggcaaccaaaacttgtgctaccaacggccaagacaacaaaaatgacgaagtttcagacttcatcaatcaacacatctactccacaacgcagctcaagatggatttatcaggttccttctcaatcatacttggactgcttgtccctatactccaagaaccatttagacaagtcctaaagagaataccattcaccatggactggaaagtggaccggacaaatcagaaattaagtggtcggcttaatgagattgtggagaagagaatgaagtgtaacgatcaaggttcaaaagacttcttatcgctcattttgagagcaagagagtcagagacagtatcaaggaatgtcttcactccagactacatcagtgcagttacgtatgaacacctacttgctgggtcggctaccacggcgtttacgttgtcttctattgtatatttagttgctgggcatccagaagtcgagaagaagttgctagaagagattgacaactttggtccatccgatcagataccaacagctaatgatcttcatcagaagtttccatatcttgatcaggtgattaaagaggctatgaggttctacactgtttcccctctagtagccagagaaacagctaaagatgtggagattggtggatatcttcttccaaaggggacatgggtttggttagcacttggagttcttgccaaggatccaaagaactttccagaaccagataaattcaaaccagagaggtttgatccaaatgaagaagaggagaaacaaaggcatccttatgctttaatcccctttggaattggtcctcgagcatgcattggtaaaaaattcgcccttcaggagttgaagctctcgttgattcatttgtacaggaagtttgtatttcggcat

SEQ ID NO: 38 - DNA, 1566 bp, Artificial Sequence
  Nucleotide sequence encoding CYP396810
atggaaatcattttatcatatctcaacagctccatagctggactcttcctcttgcttctcttctcgttttttgttttgaaaaaggctagaacctgtaaacgcagacagcctcctgaagcagccggcggatggccgatcatcggccacctgagactgctcgggggttcgcaacttccccatgaaaccttgggagccatggccgacaagtatggaccaatcttcagcatccgagttggtgtccacccatctcttgttataagcagttgggaagtggctaaagagtgctacaccaccctcgactcagttgtctcttctcgtcccaagagtttgggtggaaagttgttgggctacaacttcgccgcttttgggttcaggccttatgattccttttaccggagtatccgcaaaaccatagcctccgaggtgctgtcgaaccgccgtctggagttgcagagacacattcgagtttctgaggtgaagagatcggtgaaggagctttacaatctgtggacgcagagagaggaaggctcagaccacatacttattgatgcggatgaatggattggtaatattaatttgaacgtgattctgatgatggtttgtgggaagcggtttcttggcggttctgccagcgatgagaaggagatgaggcggtgtctcaaagtctcgagagatttcttcgatttgacagggcagtttacggtgggagatgccattcctttcctgcgatggctggatttgggtggatatgcgaaggcgatgaagaaaactgcaaaagaaatggactgtctcgttgaggaatggctggaagaacaccgccggaagagagactccggcgccaccgacggtgaacgtgacttcatggatgtgatgctttcgattcttgaagagatggaccttgctggctacgacgctgacacagtcaacaaagccacatgcctgagcattatttctgggggaatcgatactataacgctaactctgacatgggcgatctcgttattgctgaacaatcgagaggcactgcgaagggttcaagaggaggtggacatccatgtcggaaacaaaaggcttgtggatgaatcagacttgagcaagctggtgtatctccaagccgtcgtgaaagagacattaaggttgtacccagcagggccgctgtcgggagctcgagagttcagtcgggactgcacggtcggagggtatgacgtggccgccggcacacggctcatcacaaacctttggaagatacagacggaccctcgggtgtggccggagccacttgagttcaggccggagaggtttctgagcagccaccagcagttggatgtgaagggccagaactttgaactggccccatttggttgtggaagaagagtgtgccctggggcggggcttggggttcagatgacgcagttggtgctggcgagtctgattcattcggtggaacttggaactcgctccgatgaagcggtggacatggctgctaagtttggactcacaatgtacagagccacccctcttcaggctctcgtcaagccacgcctccaagccggtgcttattcatga

SEQ ID NO: 39 - DNA, 1425 bp, Artificial Sequence
  Nucleotide sequence encoding CYP4112
atgggtgtattgtccattttattattcagatattccgtcaagaagaagccattaagatgcggtcacgatcaaagaagtaccacagatagtccacctggttcaagaggtttgccattgataggtgaaactttgcaattcatggctgctattaattctttgaacggtgtatacgatttcgttagaataagatgtttgagatacggtagatgctttaagacaagaatcttcggtgaaacccatgtttttgtctcaactacagaatccgctaagttgatcttgaaggatggtggtgaaaaattcaccaaaaagtacatcagatcaatcgctgaattggttggtgacagaagtttgttatgtgcatctcatttgcaacacaagagattgagaggtttgttgactaatttgttttctgccacattcttggcttctttcgtaactcaattcgatgaacaaatcgttgaagcttttagatcatgggaatccggtagtaccataatcgttttgaacgaagcattgaagatcacttgtaaggccatgtgcaaaatggtcatgtccttagaaagagaaaacgaattggaagctttgcaaaaggaattgggtcatgtttgtgaagctatgttggcatttccatgcagattccctggtacaagatttcacaatggtttgaaggcaagaagaagaatcattaaagttgtcgaaatggccattagagaaagaagaagatctgaagctcctagagaagatttcttgcaaagattgttgacagaagaaaaggaagaagaagacggtggtggtgttttaagtgatgccgaaattggtgacaacatattgacaatgatgatcgcaggtcaagataccactgcctctgctattacctggatggtcaagtttttggaagaaaaccaagatgtattgcaaaacttaagagacgaacaattcgaaatcatgggtaaacaagaaggttgtggttcatgcttcttgacattagaagatttgggtaatatgtcctatggtgcaaaagtagttaaggaatcattgagattagcctccgtcgtaccatggtttcctagattggttttacaagattctttgatccaaggttacaaaattaaaaagggttggaacgtcaacatagacgtaagatctttacattcagatccatccttgtataatgacccaacaaagtttaaccctagtagattcgatgacgaagctaaaccttactcatttttggcattcggtatgggtggtagacaatgtttgggtatgaacatggcaaaggccatgatgttggttttcttgcacagattggtcacctcattcagatggaaggttatagattccgactcttcaatcgaaaaatgggctttgttctctaagttgaagtcaggttgccctatcgtagttacccacatcggttcctaa

SEQ ID NO: 40 - DNA, 1509 bp, Artificial Sequence
  Nucleotide sequence encoding CYP414912
atggatttctactggatctgtgttcttctgctttgcttcgcatggttttccattttatcccttcactcgagaacaaacagcagcggcacttccaaacttcctcccggaccgaaacccttgccgatcatcggaagccttttggctctcggccacgagccccacaagtctttggctaatctcgctaaatctcatggccctcttatgaccttaaagctcggccaaatcaccaccgtcgtagtttcctccgctgccatggctaagcaagttctccaaacgcacgaccagtttctgtccagcaggaccgttccagacgcaatgacctctcacaaccacgatgctttcgcactcccatggattccggtttcacccctctggcgaaaccttcgacgaatatgcaacaaccagttgtttgccggcaagattctcgacgccaacgagaatctccggcgaaccaaagtggccgagctcgtatccgatatctcgagaagtgcattgaaaggtgagatggtggattttggaaacgtggtgttcgtcacttcgctcaatctgctttccaatacgattttctcggtggatttcttcgacccaaattctgaaattgggaaagagttcaggcacgcagtacgaggcctcatggaagaagctgccaaaccaaatttgggggattatttccctctgctgaagaagatagatcttcaaggaataaagaggagacagaccacttacttcgatcgggtttttaatgttttggagcacatgatcgaccagcgtcttcagcagcagaagacgacgtctggttctacctccaacaacaacaacgacttactgcactaccttctcaacctcagcaacgaaaatagcgacatgaaattggggaaacttgagctgaaacacttcttattggtgctattcgtcgctgggactgaaacgagttctgcaacactgcaatgggcaatggcagaactactaagaaacccagaaaagttagcaaaagctcaagcggagaccaggcgggtgattgggaaagggaacccaattgaagaatcagacatttcgaggctgccttatctgcaagcagtggtgaaagaaactttcagattgcacacaccagcgccatttctactgccgcgcaaagcactacaggacgtggaaattgcaggtttcacagtcccaaaggacgctcaggtactggtaaatttatgggctatgagcagagattcaagcatctgggagaacccagagtggttcgagccagaaaggtttttggagtcggagctggacgttagagggagagattttgagctgatcccgttcggcggtgggcggaggatttgccccggtctgccgttggcgatgagaatgttgcatttgattttgggttctctcatccacttctttgattggaagcttgaagatgggtgtcggccggaagacgtgaaaatggacgaaaagcttggcctcactctggagttggcttttcccctcacagccttgcctgtccttgtctaa

SEQ ID NO: 41 - DNA, 1734 bp, Artificial Sequence
  Nucleotide sequence encoding CYP449113
atgtcctcctgcggtggtccaactcctttgaatgttatcggtatcttattacaatcagaatcctccagagcctgcaactcagacgaaaactcaagaattttgagagatttcgtaacaagagaagttaacgctttcttatggttgtccttgatcactatcacagcagttttgatcagtaaagttgtcggtttgtttagattgtggtctaaggcaaagcaattgagaggtccaccttgtccatcattctacggtcattctaagatcatctcaagacaaaatttgactgatttgttatatgactcccacaaaaagtacggtccagtagttaaattgtggttaggtcctatgcaattgttagtctccgtaaaggaaccaagtttgttgaaggaaatattggttaaagctgaggataagttgcctttaacaggtagagcctttagattggctttcggtagatcttcattatttgcatccagtttcgaaaaggttcaaaacagaagacaaagattggccgaaaagttgaataagatcgcattccaaagagccaacatcattccagaaaaggccgtagcttgtttcatgggtagagttcaagatttgatgatagaagaatctgtcgactgtaataaggtttctcaacatttggcttttactttgttaggttgcacattgtttggtgacgccttcttaggttggtctaaggctacaatctatgaagaattgttgatgatgatcgctaaggacgcatccttttgggctagttatagagttaccccaatctggaagcaaggtttctggagataccaaagattgtgtatgaagttgaagtgcttgactcaagatatcgttcaacaatacagaaagcattacaagttgttttctcactcacaaaaccaaaacttacacaacgaaaccaagtcaactggtgttgaagtcgcttttgatattccaccttgtcctgctgcagacgttagaaattcttgctttttctacggtttgaacgatcatgttaacccaaacgaagaaccttgtggtaatattatgggtgtcatgtttcacggttgcttgactacaacctctttgatcgcatcaatcttggaaagattggccactaacccagaaatccaagaaaagattaattctgaattgaacttagttcaaaagggtccagtcaaggatcatagaaagaatgttgacaacatgcctttgttattggcaacaatctatgaatcagctagattattgccagcaggtcctttattgcaaagatgtcctttgaagcaagatttggttttgaaaacaggtatcaccattccagctggtaccttggtcgtagttcctattaaattggttcaaatggatgactcttcatggggttcagatgccaatgagtttaatccatacagattcttgtccatggcttgtaatggtattgacatgatacaaagaacccctttagctggtgaaaacattggtgaccaaggtgaaggttcatttgtcttgaatgacccaattggtaacgtaggtttcttaccttttggtttcggtgcaagagcctgcgttggtcaaaagtttataatccaaggtgtcgctactttgttcgcaagtttgttggcccattacgaaattaaattgcaatccgagagtaagaatgattctaaaccatccagtaacacctctgccagtcaaatcgtcccaaactcaaaaatcgtattcgtaagaagaaactcataa

SEQ ID NO: 42 - DNA, 1422 bp, Artificial Sequence
  Nucleotide sequence encoding CYP549114
atgtggactgtcgtgctcggtttggcgacgctgtttgtcgcctactacatccattggattaacaaatggagagattccaagttcaacggagttctgccgccgggcaccatgggtttgccgctcatcggagagacgattcaactgagtcgacccagtgactccctcgacgttcaccctttcatccagaaaaaagttgaaagatacgggccgatcttcaaaacatgtctggccggaaggccggtggtggtgtcggcggacgcagagttcaacaactacataatgctgcaggaaggaagagcagtggaaatgtggtatttggatacgctctccaaatttttcggcctcgacaccgagtggctcaaagctctgggcctcatccacaagtacatcagaagcattactctcaatcacttcggcgccgaggccctgcgggagagatttcttccttttattgaagcatcctccatggaagcccttcactcctggtctactcaacctagcgtcgaagtcaaaaatgcctccgctctcatggtttttaggacctcggtgaataagatgttcggtgaggatgcgaagaagctatcgggaaatatccctgggaagttcacgaagcttctaggaggatttctcagtttaccactgaattttcccggcaccacctaccacaaatgcttgaaggatatgaaggaaatccagaagaagctaagagaggttgtagacgatagattggctaatgtgggccctgatgtggaagatttcttggggcaagcccttaaagataaggaatcagagaagttcatttcagaggagttcatcatccaactgttgttttctatcagttttgctagctttgagtccatctccaccactcttactttgattctcaagctccttgatgaacacccagaagtagtgaaagagttggaagctgaacacgaggcgattcgaaaagctagagcagatccagatggaccaattacttgggaagaatacaaatccatgacttttacattacaagtcatcaatgaaaccctaaggttggggagtgtcacacctgccttgttgaggaaaacagttaaagatcttcaagtaaaaggatacataatcccggaaggatggacaataatgcttgtcaccgcttcacgtcacagagacccaaaagtctataaggaccctcatatcttcaatccatggcgttggaaggacttggactcaattaccatccaaaagaacttcatgccttttgggggaggcttaaggcattgtgctggtgctgagtactctaaagtctacttgtgcaccttcttgcacatcctctgtaccaaataccgatggaccaaacttgggggaggaaggattgcaagagctcatatattgagttttgaagatgggttacatgtgaagttcacacccaaggaatga

SEQ ID NO: 43 - DNA, 1374 bp, Artificial Sequence
  Nucleotide sequence encoding CYP647915
atgaagatgaagatggaatccatgcgcacctccctggatatctccgaccatgacatacttccaagggtttatcctcatgttcacctatggatcaacaaatatgggaaaaacttcattcagtggaatggcaacgtagctcagttgattgtttcggatcctgacacgatcaaggagatactccaaaaccgagaacaagctgttcccaaaatagatctcagcggagatgcacggaggatattcgggaatgggctttcgacttctgacggtgaaaaatgggctaaggctcgaagaatcgctgattacgctttccacggggatctcctaagaaatatggggccaaccatggtttcctgtgctgaggcaatggtggaaaagtggaagcatcatcaaggcaaagagcttgatttgttcgaagagtttaaggtgctcacttcagatatcattgcacatacagcctttggaagcagttatttggaagggaaagttatttttcagactctaagtaagctgagcatgatattatttaagaatcagttcaaacgaaggattcctgttatcagcaagttcttcagatcaaaggatgcgagggagggagaggagctggaaagaaggttgaaaaattccataatttcaataatggaaaagagagaagagaaggtgataagtggtgaagcagataactatggtaatgattttcttggattacttttgaaggcaaagaatgagcctgaccagaggcagaggatttctgttgatgatgtagtggatgaatgcaaaacagtttacttcgctgggcaagaaactacaagtgttttgcttgcttggaccgcctttcttttagcaactcatgagcattggcaagaagaagcaagaaaggaagtgctgaatatgtttggcaacaagaatccaactttagaaggcatcacaaaattaaagattatgagcatgatcatcaaggaatctctaagattatatcctccagccccgcccatgtcaaggaaggttaaaaaggaagtcagattggggaagctggttctcccccccaacattcaagtaagcatctcaactattgcagttcatcatgatactgcaatatggggtgaagatgcccatgtattcaaaccagaaagattttctgaaggaacagctaaagatatcccatcagctgcatacatcccatttggctttggtcctcgaaactgcatcggcaatatcttggccatcaacgaaactaagattgcactgtcgatgattctacaacgattttctttcaccatctccccggcctacgtccacgcacctttccagttcctcactatctgcccccaacacggggttcaggtaaagcttcagtccctattaagtgaaaggtga

SEQ ID NO: 44 - DNA, 1590 bp, Artificial Sequence
  Nucleotide sequence encoding CYP760416
atggaagctgaatttggtgccggtgctactatggtattatccgttgtcgcaatcgtcttctttttcacatttttacacttgtttgaatctttctttttgaagccagatagattgagatctaagttgagaaagcaaggtattggtggtccatctccttcatttttgttgggtaatttgtcagaaattaaatccatcagagctttgtcttcacaagctaagaacgcagaagatgcctctgctggtggtggtggtggttccgccagtatagctcatggttggacttcaaatttgtttcctcacttagaacaatggagaaacagatatggtccaattttcgtatactccagtggtacaatccaaatcttgtgtatcacagaaatggaaaccgttaaggaaatctctttgtcaacctccttgagtttaggtaaacctgctcatttgtctaaggatagaggtccattgttaggtttgggtatcttagcctcttcaggtcctatttgggttcaccaaagaaagatcatcgctccacaattgtatttggataaagtaaagggtatgacctcattgatggttgaaagtgcaaattctatgttaagatcctgggaaactaaagttgaaaatcatggtggtcaagccgaaattaacgtcgatggtgacttgagagcattaagtgccgatatcatttctaaggcttgctttggttcaaactattccgaaggtgaagaaattttcttgaagttgagagcattgcaagttgtcatgagtaagggttctattggtatacctggttttagatacataccaactaaaaataacagagaaatgtggaagttggaaaaggaaatcgaatcaatgatcttgaaggttgccaacgaaagaacacaacattccagtcacgaacaagatttgttgcaaatgattttggaaggtgcaaagtctttgggtgaagacaataagagtatgaacatatcaagagacaagtttattgttgacaattgtaagaacatctatttcgctggtcatgaaactacagctataaccgcatcttggtgcttgatgttgttagctgcacaccctgattggcaagcaagagccagatctgaagttttacaatgttgcgatgacagaccaatcgatgcagacacagtcaaaaatatgaagaccttgactatggtaattcaagaaactttgagattgtacccacctgctgtattcgttacaagacaagcattagaagatatcagattcaaaaacatcacaataccaaagggtatgaactttcatataccaatccctatgttgcaacaagacttccacttatggggtcctgatgcttgttcatttgacccacaaagattctccaatggtgtcttaggtgcatgcaaaaacccacaagcctatatgccttttggtgttggtccaagagtctgtgccggtcaacatttcgctatgatcgaattgaaagtcatcgtatcattggttttgtccagattcgaattttctttgtcaccttcctacaagcattcaccagccttcagattagttgtcgaaccagaaaacggtgtcatattgcatgtcagaaagttgtga

SEQ ID NO: 45 - DNA, 1554 bp, Artificial Sequence
  Nucleotide sequence encoding CYP822417
atggaagtggatatcaatatcttcaccgtcttttccttcgtattatgcacagtcttcctcttctttctatccttcttgatcctcctcctcctccgaacgctcgccggaaaatccataacgagctccgagtacacgccagtgtacggcaccgtctacggtcaggctttctatttcaacaacctgtacgatcatctaacggaggtggccaagagacatcgaaccttccggctgcttgcgccggcatacagcgagatatacacgaccgatccgagaaacatcgagcatatgttgaagacgaaattcgataagtattcgaaaggaagcaaggatcaagaaatcgttggggatctgtttggagaggggatatttgcagtcgatggagataagtggaagcagcagaggaagctggctagctatgaattctcgacgaggattcttagggattttagctgctcggttttcagacgaagtgctgctaaacttgttggagttgtttcggagttttccagcatgggtcgggtttttgatatccaggatttgctaatgcggtgcgctttggactccattttcaaagtggggttcggggttgatttgaattgcttggaggaatcaagcaaagaagggagcgatttcatgaaagccttcgatgattctagcgctcagattttttggcgctatatcgatcccttctggaaattgaagagattgcttaacatcggttccgaagcttcgtttaggaacaacataaaaaccatagatgcttttgtgcaccagttgatcagagacaagagaaaattgcttcagcaaccgaatcacaagaatgacaaagaggacatactttggaggtttctgatggaaagtgagaaggatccaacaagaatgaatgatcaatatctaagggatatagtcctcaatttcatgttggctggcaaagattcaagtggaggaactctgtcctggttcttctacatgctatgcaagaaccctttaatacaggaaaaagttgcagaagaagtgaggcaaattgttgcgtttgaaggggaagaagttgacatcaatttgttcatacaaaacttaactgattcagctcttgacaaaatgcattatcttcatgcagcattgaccgagactctgaggctatatcctgcagtccctttggatggaaggactgcagaaatagatgacattcttcctgatggctataaactaagaaaaggggatggagtatactacatggcctattccatgggcaggatgtcctccctttggggagaagatgctgaagattttaaacccgaaagatggcttgaaagtggaacttttcaacccgaatcacctttcaaattcatcgcttttcatgcgggtcctcgaatgtgtttgggaaaagagtttgcttatcgacaaatgaagatagtatctgctgctttgcttcaattttttcgattcaaagtagctgatacaacgaggaatgtgacttataggatcatgcttacccttcacattgatggaggtctccctcttcttgcaattccgagaattagaaaatttacctaa

SEQ ID NO: 46 - DNA, 1686 bp, Artificial Sequence
  Nucleotide sequence encoding CYP872818
ttggatagtggagttaaaagagtgaaacggctagttgaagagaaacggcgagcagaattgtctgcccggattgcctctggagaattcacagtcgaaaaagctggttttccatctgtattgaggagtggcttatcaaagatgggtgttcccagtgagattctggacatattatttggtttcgttgatgctcaagaagaatatcccaagattcccgaagcaaaaggatcagtaaatgcaattcgtagtgaggccttcttcatacctctctatgagctttatctcacatatggtggaatatttaggttgacttttgggccaaagtcattcttgatagtttctgatccttccattgctaaacatatactgaaggataatccgaggaattattctaagggtatcttagctgaaattctagagtttgtcatggggaagggacttataccagctgacgagaagatatggcgtgtacgaaggcgggctatagtcccatctttgcatctgaagtatgtaggtgctatgattaatctttttggagaagctgcagataggctttgcaagaagctagatgctgcagcatctgatggggttgatgtggaaatggagtccctgttctcccgtttgactttagatatcattggcaaggcagtttttaactatgactttgattcacttacaaatgacactggcatagttgaggctgtttacactgtgctaagagaagcagaggatcgcagtgttgcaccaattccagtatgggaaattccaatttggaaggatatttcaccacggcaaaaaaaggtctctaaagccctcaaattgatcaacgacaccctcgatcaactaattgctatatgcaagaggatggttgatgaggaggagctgcagtttcatgaggaatacatgaatgagcaagatccaagcatccttcatttccttttggcatcaggagatgatgtttcaagcaagcagcttcgtgatgacttgatgactatgcttatagctgggcatgaaacatctgctgcagttttaacatggaccttttatcttctttccaaggagccgaggatcatgtccaagctccaggaggaggttgattcagtccttggggatcggtttccaactattgaagatatgaagaacctcaaatatgccacacgaataattaacgaatccttgaggctttacccacagccaccagttttaatacgtcgatctcttgacaatgatatgctcgggaagtaccccattaaaaagggtgaggacatattcatttctgtttggaacttgcatcgcagtccaaaactctgggatgatgcggataaatttaatcctgaaaggtggcctctggatggacccaatccaaatgagacaaatcaaaatttcagatatttaccttttggtggcggaccacggaaatgtgtgggagacatgtttgcttcgtacgagactgttgtagcacttgcaatgcttgttcggcgatttgacttccaaatggcacttggagcacctcctgtaaaaatgacaactggagctacaattcacacaacagatggattgaaaatgacagttacacgaagaatgagacctccaatcatacccacattagagatgcctgcagtggtcgttgactcgtctgtcgtggactcgtccgtcgccattttgaaagaagaaacacaaattggttag

SEQ ID NO: 47 - DNA, 1299 bp, Artificial Sequence
  Nucleotide sequence encoding CY1002019
cagttcctctcctggtcctcccagtttggcaagaggttcatcttctggaatgggatcgagcccagaatgtgcctcaccgagaccgatttgatcaaagagcttctctctaagtacagcgccgtctccggtaagtcatggcttcagcaacagggctccaagcacttcatcggccgcggtctcttaatggccaacggccaaaactggtaccaccagcgtcacatcgtcgcgccggccttcatgggagacagactcaagagttacgccgggtacatggtggaatgcacaaaggagatgcttcagtcaattgaaaacgaggtcaactcggggcgatccgagttcgaaatcggtgagtatatgaccagactcaccgccgatataatatcacgaaccgagttcgaaagcagctacgaaaagggaaagcaaattttccatttgctcaccgttttacagcatctctgcgctcaggcgagccgccacctctgccttcctggaagccggttttttccgagtaaatacaacagagagataaaggcattgaagacgaaggtggaggggttgttaatggagataatacagagcagaagagactgtgtggaggtggggaggagcagttcgtatggaaatgatctgttgggaatgttgctgaatgagatgcagaagaagaaagatgggaatgggttgagcttgaatttgcagattataatggatgaatgcaagaccttcttcttcgccggccatgaaaccactgctcttttgctcacttggactgtaatgttattggccagcaacccttcttggcaacacaaggttcgagccgaagttatggccgtctgcaatggaggaactctctctcttgaacatctctccaagctctctctgttgagtatggtgataaatgaatcgttgaggctatacccgccagcaagtattcttccaagaatggcatttgaagatataaagctgggagatcttgagatcccaaaagggctgtcgatatggatcccagtgcttgcaattcaccacagtgaagagctatggggcaaagatgcaaatgagttcaacccagaaagatttgcaaattcaaaagccttcacttcggggagattcattccctttgcttctggccctcgcaactgcgttggccaatcatttgctctcatggaaaccaagatcattttggctatgctcatctccaagttttccttcaccatctctgacaattatcgccatgcacccgtggtcgtcctcactataaaacccaaatacggagtccaagtttgcttgaagcctttcaattaa

SEQ ID NO: 48 - DNA, 1506 bp, Artificial Sequence
  Nucleotide sequence encoding CYP10285
atggaagacaccttcctactctatccttccctctctcttctctttcttctttttgctttcaagctcatccgtcgatccggaggagttcgcaggaacttaccgccgagtccgccctctcttccggttatcggccacctccatctcttgaaaaagccactccaccggactttccagaaactttccgccaaatatggtcctgttatgtccctccgcctcgggtctcgcctcgcagtcattgtatcgtcgtcgtcggcggtggacgagtgtttcactaaaaacgacgtcgtgctcgccaaccgtcctcgtttgctaattggcaaacacctcggctacaactacactaccatggttggggctccctacggcgaccactggcgtagcctccgccgcatcggtgccctcgaaatcttctcttcatctcgcctcaacaaattcgccgacatccgaagggatgaagtagagggattgcttcgcaaactctcacgcaattcgctccatcaattctcgaaagtggaagttcaatcggccttgtcggagctgacgttcaacatctcgatgagaatggcggcagggaaacggtattacggagatgacgtgacggacgaggaagaggcgagaaagttcagagagttaattaaacagatagtggcgctgggcggagtatcaaatccaggggatttcgtcccgattctgaattggattccgaacggtttcgagaggaagttgatcgagtgtgggaagaagacggatgcgttcttgcaggggctgatcgaggaccaccggagaaagaaggaagagggtaggaacacgatgatcgatcacctgctctctctgcaagaatcggagcctgctcactacggagaccaaataatcaaaggatttatactggtgttactgacggcggggaccgatacatcggccgtgacaatggagtgggcgctatctcatctcctgaacaatcctgaagtgctaaagaaggcaagagatgaggtcgacactgaaattggacaagaacgacttgtcgaagaatcagacgtagtatctaagttaccctatcttcaagggatcatctccgagactctccggctgaatcccgccgctccgatgttgttgccccattacgcctcggacgactgcacgatatgtggatacgacgtgccacgtgacacaatcgtaatggtcaatgcatgggccatacatagggatccaaacgaatgggaggagcccacgtgtttcagaccagaacgatatgaaaagtcgtcgtcggaagcggaggtacacaagtcggtgagtttcggggtgggaaggcgagcttgtcctgggtctggcatggcgcagagggtgatgggcttgactttggcggcactggttcagtgcttcgagtgggagagagttggagaagaagaagtggacatgaacgaaggctcaggtgccacaatgcccaagatggtgccattggaggccatgtgcagagctcgtcccatcgtccacaaccttctttactga

SEQ ID NO: 49 - protein, 473 aa, Artificial Sequence
  Amino acid sequence of CYP5491
MWTVVLGLATLFVAYYIHWINKWRDSKFNGVLPPGTMGLPLIGETIQLSRPSDSLDVHPFIQKKVERYGPIFKTCLAGRPVVVSADAEFNNYIMLQEGRAVEMWYLDTLSKFFGLDTEWLKALGLIHKYIRSITLNHFGAEALRERFLPFIEASSMEALHSWSTQPSVEVKNASALMVFRTSVNKMFGEDAKKLSGNIPGKFTKLLGGFLSLPLNFPGTTYHKCLKDMKEIQKKLREVVDDRLANVGPDVEDFLGQALKDKESEKFISEEFIIQLLFSISFASFESISTTLTLILKLLDEHPEVVKELEAEHEAIRKARADPDGPITWEEYKSMTFTLQVINETLRLGSVTPALLRKTVKDLQVKGYIIPEGWTIMLVTASRHRDPKVYKDPHIFNPWRWKDLDSITIQKNFMPFGGGLRHCAGAEYSKVYLCTFLHILCTKYRWTKLGGGRIARAHILSFEDGLHVKFTPKE

SEQ ID NO: 50 - protein, 496 aa, Artificial Sequence
  Saccharomyces cerevisiae protein sequence of squalene epoxidase
MSAVNVAPELINADNTITYDAIVIGAGVIGPCVATGLARKGKKVLIVERDWAMPDRIVGELMQPGGVRALRSLGMIQSINNIEAYPVTGYTVFFNGEQVDIPYPYKADIPKVEKLKDLVKDGNDKVLEDSTIHIKDYEDDERERGVAFVHGRFLNNLRNITAQEPNVTRVQGNCIEILKDEKNEVVGAKVDIDGRGKVEFKAHLTFICDGIFSRFRKELHPDHVPTVGSSFVGMSLFNAKNPAPMHGHVILGSDHMPILVYQISPEETRILCAYNSPKVPADIKSWMIKDVQPFIPKSLRPSFDEAVSQGKFRAMPNSYLPARQNDVTGMCVIGDALNMRHPLTGGGMTVGLHDVVLLIKKIGDLDFSDREKVLDELLDYHFERKSYDSVINVLSVALYSLFAADSDNLKALQKGCFKYFQRGGDCVNKPVEFLSGVLPKPLQLTRVFFAVAFYTIYLNMEERGFLGLPMALLEGIMILITAIRVFTPFLFGELIG

SEQ ID NO: 51 - protein, 525 aa, Artificial Sequence
  Amino acid sequence of Gynostemma pentaphyllum Squalene epoxidase
MVDQFSLAFIFASVLGAVAFYYLFLRNRIFRVSREPRRESLKNIATTNGECKSSYSDGDIIIVGAGVAGSALAYTLGKDGRRVHVIERDLTEPDRTVGELLQPGGYLKLTELGLEDCVNEIDAQRVYGYALFKDGKDTKLSYPLEKFHSDVSGRSFHNGRFIQRMREKAATLPNVRLEQGTVTSLLEENGIIKGVQYKSKTGQEMTAYAPLTIVCDGCFSNLRRSLCNPKVDVPSCFVALVLENCELPHANYGHVILADPSPILFYPISSTEVRCLVDVPGQKVPSISNGEMANYLKSVVAPQIPPQIYDALRSCYDKGNIRTMPNRSMPADPYPTPGALLMGDAFNMRHPLTGGGMTVALSDIVVLRDLLKPLRDLHDAPILSNYLEAFYTLRKPVASTINTLAGALYKVFCASPDQARREMRQACFDYLSLGGVFSNGPVSLLSGLNPRPLSLVLHFFAVAIYGVGRLLIPFPSPRRVWIGARLISGASGIIFPIIKAEGVRQIFFPATLPAYYRAPPLVRGR

SEQ ID NO: 52 - protein, 531 aa, Artificial Sequence
  Amino acid sequence of Arabidopsis thaliana Squaiene epoxidase 1
MESQLWNWILPLLISSLLISFVAFYGFFVKPKRNGLRHDRKTVSTVTSDVGSVNITGDTVADVIVVGAGVAGSALAYTLGKDKRRVHVIERDLSEPDRIVGELLQPGGYLKLLELGIEDCVEEIDAQRVYGYALFKNGKRIRLAYPLEKFHEDVSGRSFHNGRFIQRMREKAASLPNVQLEQGTVLSLLEENGTIKGVRYKNKAGEEQTAFAALTIVCDGCFSNLRRSLCNPQVEVPSCFVGLVLENCNLPYANHGHVVLADPSPILMYPISSTEVRCLVDVPGQKVPSIANGEMKNYLKTVVAPQMPHEVYDSFIAAVDKGNIKSMPNRSMPASPYPTPGALLMGDAFNMRHPLTGGGMTVALADIVVLRNLLRPLRDLSDGASLCKYLESFYTLRKPVAATINTLANALYQVFCSSENEARNEMREACFDYLGLGGMCTSGPVSLLSGLNPRPLTLVCHFFAVAVYGVIRLLIPFPSPKRIWLGAKLISGASGIIFPIIKAEGVRQMFFPATVPAYYYKAPTVGETKCS

SEQ ID NO: 53 - protein, 516 aa, Artificial Sequence
  Amino acid sequence of Arabidopsis thaliana Squalene epoxidase 4
MTYAWLWTLLAFVLTWMVFHLIKMKKAATGDLEAEAEARRDGATDVIIVGAGVAGASLAYALAKDGRRVHVIERDLKEPQRFMGELMQAGGRFMLAQLGLEDCLEDIDAQEAKSLAIYKDGKHATLPFPDDKSFPHEPVGRLLRNGRLVQRLRQKAASLSNVQLEEGTVKSLIEEEGVVKGVTYKNSAGEEITAFAPLTVVCDGCYSNLRRSLVDNTEEVLSYMVGYVTKNSRLEDPHSLHLIFSKPLVCVIYQITSDEVRCVAEVPADSIPSISNGEMSTFLKKSMAPQIPETGNLREIFLKGIEEGLPEIKSTATKSMSSRLCDKRGVIVLGDAFNMRHPIIASGMMVALSDICILRNLLKPLPNLSNTKKVSDLVKSFYIIRKPMSATVNTLASIFSQVLVATTDEAREGMRQGCFNYLARGDFKTRGLMTILGGMNPHPLTLVLHLVAITLTSMGHLLSPFPSPRRFWHSLRILAWALQMLGAHLVDEGFKEMLIPTNAAAYRRNYIATTTV

SEQ ID NO: 54 - protein, 517 aa, Artificial Sequence
  Amino acid sequence of Arabidopsis thaliana Squalene epoxidase 6
MAFTHVCLWTLVAFVLTWTVFYLTNMKKKATDLADTVAEDQKDGAADVIIVGAGVGGSALAYALAKDGRRVHVIERDMREPERMMGEFMQPGGRLMLSKLGLQDCLEDIDAQKATGLAVYKDGKEADAPFPVDNNNFSYEPSARSFHNGRFVQQLRRKAFSLSNVRLEEGTVKSLLEEKGVVKGVTYKNKEGEETTALAPLTVVCDGCYSNLRRSLNDDNNAEIMSYIVGYISKNCRLEEPEKLHLILSKPSFTMVYQISSTDVRCGFEVLPENFPSIANGEMSTFMKNTIVPQVPPKLRKIFLKGIDEGAHIKVVPAKRMTSTLSKKKGVIVLGDAFNMRHPVVASGMMVLLSDILILRRLLQPLSNLGDANKVSEVINSFYDIRKPMSATVNTLGNAFSQVLIGSTDEAKEAMRQGVYDYLCSGGFRTSGMMALLGGMNPRPLSLVYHLCAITLSSIGQLLSPFPSPLRIWHSLKLFGLAMKMLVPNLKAEGVSQMLFPANAAAYHKSYMAATTL

SEQ ID NO: 55 - protein, 516 aa, Artificial Sequence
  Amino acid sequence of Arabidopsis thaliana Squalene epoxidase 5
MAFTNVCLWTLLAFMLTWTVFYVTNRGKKATQLADAVVEEREDGATDVIIVGAGVGGSALAYALAKDGRRVHVIERDLREPERIMGEFMQPGGRLMLSKLGLEDCLEGIDAQKATGMTVYKDGKEAVASFPVDNNNFPFDPSARSFHNGRFVQRLRQKASSLPNVRLEEGTVKSLIEEKGVIKGVTYKNSAGEETTALAPLTVVCDGCYSNLRRSLNDNNAEVLSYQVGFISKNCQLEEPEKLKLIMSKPSFTMLYQISSTDVRCVFEVLPNNIPSISNGEMATFVKNTIAPQVPLKLRKIFLKGIDEGEHIKAMPTKKMTATLSEKKGVILLGDAFNMRHPAIASGMMVLLSDILILRRLLQPLSNLGNAQKISQVIKSFYDIRKPMSATVNTLGNAFSQVLVASTDEAKEAMRQGCYDYLSSGGFRTSGMMALLGGMNPRPISLIYHLCAITLSSIGHLLSPFPSPLRIWHSLRLFGLAMKMLVPHLKAEGVSQMLFPVNAAAYSKSYMAATAL

SEQ ID NO: 56 - protein, 585 aa, Artificial Sequence
  Amino acid sequence of Arabidopsis thaliana Squalene epoxidase 2
MKPFVIRNLPRFQSTLRSSLLYTNHRPSSRFSLSTRRFTTGATYIRRWKATAAQTLKLSAVNSTVMMKPAKIALDQFIASLFTFLLLYILRRSSNKNKKNRGLVVSQNDTVSKNLETEVDSGTDVIIVGAGVAGSALAHTLGKEGRRVHVIERDFSEQDRIVGELLQPGGYLKLIELGLEDCVKKIDAQRVLGYVLFKDGKHTKLAYPLETFDSDVAGRSFHNGRFVQRMREKALTLSNVRLEQGTVTSLLEEHGTIKGVRYRTKEGNEFRSFAPLTIVCDGCFSNLRRSLCKPKVDVPSTFVGLVLENCELPFANHGHVVLGDPSPILMYPISSSEVRCLVDVPGQKLPPIANGEMAKYLKTRVAPQVPTKVREAFITAVEKGNIRTMPNRSMPADPIPTPGALLLGDAFNMRHPLTGGGMTVALADIVVLRDLLRPIRNLNDKEALSKYIESFYTLRKPVASTINTLADALYKVFLASSDEARTEMREACFDYLSLGGVFSSGPVALLSGLNPRPLSLVLHFFAVAIYAVCRLMLPFPSIESFWLGARIISSASSIIFPIIKAEGVRQMFFPRTIPAIYRAPP

SEQ ID NO: 57 - protein, 525 aa, Artificial Sequence
  Amino acid sequence of Arabidopsis thaliana Squalene epoxidase 3
MAPTIFVDHCILTTTFVASLFAFLLLYVLRRRSKTIHGSVNVRNGTLTVKSGTDVDIIIVGAGVAGAALAHTLGKEGRRVHVIERDLTEPDRIVGELLQPGGYLKLIELGLEDCVKDIDAQRVLGYALFKDGKHTKLSYPLDQFDSDVAGRSFHNGRFVQRMREKASLLPNVRMEQGTVTSLVEENGIIKGVQYKTKDGQELKSFAPLTIVCDGCFSNLRRSLCKPKVEVPSNFVGLVLENCELPFPNHGHVVLGDPSPILFYPISSSEVRCLVDVPGSKLPSVASGEMAHHLKTMVAPQVPPQIRDAFISAVEKGNIRTMPNRSMPADPIHTPGALLLGDAFNMRHPLTGGGMTVALSDIVILRDLLNPLVDLTNKESLSKYIESFYTLRKPVASTINTLAGALYKVFLASPDDARSEMRRACFDYLSLGGVCSSGPVALLSGLNPRPMSLVLHFFAVAIFGVGRLLVPLPSVKRLWLGARLISSASGIIFPIIKAEGVRQMFFPRTIPAIYRAPPTPSSSSPQ

SEQ ID NO: 58 - protein, 506 aa, Artificial Sequence
  Amino acid sequence of Brassica napus Squaiene monooxygenase 1,1
MDLAFPHVCLWTLLAFVLTWTVFYVNNRRKKVAKLPDAATEVRRDGDADVIIVGAGVGGSALAYALAKDGRRVHVIERDMREPVRMMGEFMQPGGRLLLSKLGLEDCLEGIDEQIATGLAVYKDGQKALVSFPEDNDFPYEPTGRAFYNGRFVQRLRQKASSLPTVQLEEGTVKSLIEEKGVIKGVTYKNSAGEETTAFAPLTVVCDGCYSNLRRSVNDNNAEVISYQVGYVSKNCQLEDPEKLKLIMSKPSFTMLYQISSTDVRCVMEIFPGNIPSISNGEMAVYLKNTMAPQVPPELRKIFLKGIDEGAQIKAMPTKRMEATLSEKQGVIVLGDAFNMRHPAIASGMMVVLSDILILRRLLQPLRNLSDANKVSEVIKSFYVIRKPMSATVNTLGNAFSQVLIASTDEAKEAMRQGCFDYLSSGGFRTSGMMALLGGMNPRPLSLIFHLCGITLSSIGQLLSPFPSPLGIWHSLRLFGAEGVSQMLSPAYAAAYRKSYMTATAL

SEQ ID NO: 59 - protein, 518 aa, Artificial Sequence
  Amino acid sequence of Brassica napus Squalene monooxygenase 1,2
MDMAFVEVCLRMLLVFVLSWTIFHVNNRKKKKATKLADLATEERKEGGPDVIIVGAGVGGSALAYALAKDGRRVHVIERDMREPVRMMGEFMQPGGRLMLSKLGLQDCLEEIDAQKSTGIRLFKDGKETVACFPVDTNFPYEPSGRFFHNGRFVQRLRQKASSLPNVRLEEGTVRSLIEEKGVVKGVTYKNSSGEETTSFAPLTVVCDGCHSNLRRSLNDNNAEVTAYEIGYISRNCRLEQPDKLHLIMAKPSFAMLYQVSSTDVRCNFELLSKNLPSVSNGEMTSFVRNSIAPQVPLKLRKTFLKGLDEGSHIKITQAKRIPATLSRKKGVIVLGDAFNMRHPVIASGMMVLLSDILILSRLLKPLGNLGDENKVSEVMKSFYALRKPMSATVNTLGNSFWQVLIASTDEAKEAMRQGCFDYLSSGGFRTSGLMALIGGMNPRPLSLFYHLFVISLSSIGQLLSPFPTPLRVWHSLRLLDLSLKMLVPHLKAEGIGQMLSPTNAAAYRKSYMAATVV

SEQ ID NO: 60 - protein, 531 aa, Artificial Sequence
  Amino acid sequence of Euphorbia tirucalli Squalene epoxidase
MEVIFDTYIFGTFFASLCAFLLLFILRPKVKKMGKIREISSINTQNDTAITPPKGSGTDVIIVGAGVAGAALACTLGKDGRRVHVIERDLKEPDRIVGELLQPGGYLKLVELGLQDCVEEIDAQRIVGYALFMDGNNTKLSYPLEKFDAEVSGKSFHNGRFIQRMREKAASLPNVQLEQGTVTSLLEENGTIKGVQYKTKDGQEHKAYAPLTVVCDGCFSNLRRSLCKPKVDVPSHFVGLVLENCDLPFANHGHVILADPSPILFYPISSTEVRCLVDVPGQKLPSIASGEMAKYLKTMVAKQIPPVLHDAFVSAIDKGNIRTMPNRSMPADPLPTPGALLMGDAFNMRHPLTGGGMTVALADIVLLRDLLKPLRDLNDAPALAKYLESFYTLRKPVASTINTLAGALYKVFSASPDEARKEMRQACFDYLSLGGECAMGPVSLLSGLNPSPLTLVLHFFGVAIYGVGRLLIPFPTPKGMWIGARIISSASGIIFPIIKAEGVRQVFFPATVPAIYRNPPVNGKSVEVPKS

SEQ ID NO: 61 - protein, 519 aa, Artificial Sequence
  Amino acid sequence of Medicago truncatula Squaiene epoxidase
MIDPYGFGWITCTLITLAALYNFLFSRKNHSDSTTTENITTATGECRSFNPNGDVDIIIVGAGVAGSALAYTLGKDGRRVLIIERDLNEPDRIVGELLQPGGYLKLIELGLDDCVEKIDAQKVFGYALFKDGKHTRLSYPLEKFHSDIAGRSFHNGRFILRMREKAASLPNVRLEQGTVTSLLEENGTIKGVQYKTKDAQEFSACAPLTIVCDGCFSNLRRSLCNPKVEVPSCFVGLVLENCELPCADHGHVILGDPSPVLFYPISSTEIRCLVDVPGQKVPSISNGEMAKYLKTVVAPQVPPELHAAFIAAVDKGHIRTMPNRSMPADPYPTPGALLMGDAFNMRHPLTGGGMTVALSDIVVLRNLLKPLRDLNDASSLCKYLESFYTLRKPVASTINTLAGALYKVFCASPDPARKEMRQACFDYLSLGGLFSEGPVSLLSGLNPCPLSLVLHFFAVAIYGVGRLLLPFPSPKRLWIGIRLIASASGIILPIIKAEGIRQMFFPATVPAYYRAPPDA

SEQ ID NO: 62 - protein, 526 aa, Artificial Sequence
  Amino acid sequence of Medicago truncatula Squaiene monooxygenase
MDLYNIGWILSSVLSLFALYNLIFAGKKNYDVNEKVNQREDSVTSTDAGEIKSDKLNGDADVIIVGAGIAGAALAHTLGKDGRRVHIIERDLSEPDRIVGELLQPGGYLKLVELGLQDCVDNIDAQRVFGYALFKDGKHTRLSYPLEKFHSDVSGRSFHNGRFIQRMREKAASLPNVNMEQGTVISLLEEKGTIKGVQYKNKDGQALTAYAPLTIVCDGCFSNLRRSLCNPKVDNPSCFVGLILENCELPCANHGHVILGDPSPILFYPISSTEIRCLVDVPGTKVPSISNGDMTKYLKTTVAPQVPPELYDAFIAAVDKGNIRTMPNRSMPADPRPTPGAVLMGDAFNMRHPLTGGGMTVALSDIVVLRNLLKPMRDLNDAPTLCKYLESFYTLRKPVASTINTLAGALYKVFSASPDEARKEMRQACFDYLSLGGLFSEGPISLLSGLNPRPLSLVLHFFAVAVFGVGRLLLPFPSPKRVWIGARLLSGASGIILPIIKAEGIRQMFFPATVPAYYRAPPVNAF

SEQ ID NO: 63 - protein, 534 aa, Artificial Sequence
  Amino acid sequence of Ricinus communis Squaiene monooxygenase
MADNYLLGWILCSIIGLFGLYYMVYLVVKREEEDNNRKALLQARSDSAKTMSAVSQNGECRSDNPADADIIIVGAGVAGSALAHTLGKDGRRVHVIERDLTEPDRIVGELLQPGGYLKLIELGLEDCVEEIDAQRVFGYALFMDGKHTQLSYPLEKFHSDVAGRSFHNGRFIQRMREKASSIPNVRLEQGTVTSLIEEKGIIRGVVYKTKTGEELTAFAPLTIVCDGCFSNLRRSLCNPKVDVPSCFVGLVLEDCKLPYQYHGHVVLADPSPILFYQISSTEVRCLVDVPGQKVPSISNGEMAKYLKNVVAPQVPPEIYDSFVAAVDKGNIRTMPNRSMPASPYPTPGALLMGDAFNMRHPLTGGGMTVALSDIVVLRELLKPLRDLHDAPTLCRYLESFYTLRKPVASTINTLAGALYKVFCASSDEARNEMRQACFDYLSLGGVFSTGPISLLSGLNPRPLSLVVHFFAVAIYGVGRLLLPFPSPKRVWVGARLISGASGIIFPIIKAEGVRQMFFPATVPAYYRAPPVECN

SEQ ID NO: 64 - protein, 521 aa, Artificial Sequence
  Amino acid sequence of Ricinus communis Squaiene monooxygenase
MEYKLAVAGIIASLWALFMLCSLKRKKNITRASFNNYTDETLKSSSKEICQPEIVASPDIIIVGAGVAGAALAYALGEDGRQVHVIERDLSEPDRIVGELLQPGGYLKLIELGLEDCVEKIDAQQVFGYAIFKDGKSTKLSYPLDGFQTNVSGRSFHNGRFIQRMREKATSLPNLILQQGTVTSLVEKKGTVKGVNYRTRNGQEMTAYAPLTIVCDGCFSNLRRSLCNPKVEIPSCFVALVLENCDLPYANHGHVILADPSPILFYPISSTEVRCLVDIPGQKVPSISNGELAQYLKSTVAKQIPSELHDAFISAIEKGNIRTMPNRSMPASPHPTPGALLVGDAFNMRHPLTGGGMTVALSDIVLLRNLLRPLENLNDASVLCKYLESFYILRKPMASTINTLAGALYKVFSASTDRARSEMRQACFDYLSLGGVFSNGPIALLSGLNPRPLNLVLHFFAVAVYGVGRLILPFPSPKSIWDGVKLISGASSVIFPIMKAEGIGQIFFPITKPPNHKSQTW

SEQ ID NO: 65 - protein, 458 aa, Artificial Sequence
  Amino acid sequence of Ricinus communis Squaiene monooxygenase
MGVSREENARDEKCHYYENGISLSEKSMSTDIIIVGAGVAGSALAYTLGKDGRRVHVIERDLSLQDRIVGELLQPGGYLKLIELGLEDCVEEIDAQQVFGYALYKNGRSTKLSYPLESFDSDVSGRSFHNGRFIQRMREKAASLPNVRLEEGTVTSLLEVKGTIKGVQYKTKNGEELTASAPLTIVCDGCFSNLRRSLCNPKVDIPSCFVALILENSGQKLPSISNGDMANYLKSVVAPQIPPVLSEAFISAIEKGKIRTMPNRSMPAAPHPTPGALLLGDAFNMRHPLTGGGMTVALSDIVVLRNLLKPLHDLTDASALCEYLKSFYSLRKPVASTINTLAGALYKVFSASHDPARNEMRQACFDYLSLGGVFSNGPIALLSGLNPRPLSLVAHFFAVAIYGVGRLIFPLPSAKGMWMGARMIKVASGIIFPIIRAEGVQHMFFSKTLSAFSRSQTS

SEQ ID NO: 66 - protein, 485 aa, Artificial Sequence
  Amino acid sequence of Ricinus communis Squaiene monooxygenase
MEYQYFVGGIIASALLFVLVCRLAGKRQRRALRDTVDRDEISQNSENGISQSEKNMNTDIIIVGAGVAGSTLAYTLGKDGRRVRVIERDLSLQDRIVGELLQPGGYLKLIELGLEDCVEEIDALQVFGYALYKNGRSTKLSYPLDSFDSDVSGRSFHNGRFIQRMREKAASLPNVRMEGGTVTSLLEVKGTIKGVQYKNKNGEELIACAPLTIVCDGCFSNLRRSLCNSKVDIPFCFVALILENCELPYPNHGHVILADPSPILFYRISISEIRCLVDIPAGQKLPSISNGEMANYLKSVVAPQIPPELSNAFLSAIEKGKIRTMPKRSMPAAPHPTPGALLLGDAFNMRHPLTGGVMTVALSDIVVLRSLLRPLHDLTDASALCEYLKSFYSLRKPMVSTINTLAGALYRVFSASQDPARDEMRQACFDYLSLGGVFSNGPIALLSGLNPRPLSLIVHFFAVAVYGVGRLIFPLPSAKRMWMQE

SEQ ID NO: 67 - protein, 220 aa, Artificial Sequence
  Amino acid sequence of Ricinus communis Squaiene monooxygenase
MEYQYLMGGGIMTLLFVLSYRLKRETRASVENARDEVLQNSENGISQSEKAMNTDIKLLLEQIVQKIAMLNSIRLEEGTVTSLLEVKRDIKGVQYKTKNGEELTACAPLTIVSHGCFSNLRLHVTPSTSKFKSFIGLEVDIPSSFAALILGNCELPFPNHGHVILADPSSILFYRISSSEICCLVDVPAGQKLPSISNGEMANYLKSVVAHQAFKVGLAY

SEQ ID NO: 68 - protein, 642 aa, Artificial Sequence
  Amino acid sequence of Ricinus communis Squaiene monooxygenase
MSPISIQLPPRPQLYRSLISSLSLSTYKQPPSPPSFSLTIANSPPQPQPQATVSSKTRTITRLSNSSNRVNLLQAEQHPQEPSSDLSYSSSPPHCVSGGYNIKLMEVGTDNYAVIIILGTFFASLFAFVFLSILRYNFKNKNKAKIHDETTLKTQNDNVRLPDNGSGNDVIIVGAGVAGAALAYTLGKDGRRVHVIERDLTEPDRIVGELLQPGGYLKLIELGLEDCVQEIDAQRVLGYALFKDGKNTRLSYPLEKFHADVAGRSFHNGRFIQRMREKAASLPNVKLEQGTVTSLLEENGTIKGVQYKTKDGQEIRAYAPLTIVCDGCFSNLRRSLCNPKVDVPSCFVGLVLENCQLPFANHGHVVLADPSPILFYPISSTEVRCLVDVPGQKVPSIANGEMAKYLKNVVAPQIPPVLHDAFISAIDKGNIRTMPNRSMPADPHPTPGALLMGDAFNMRHPLTGGGMTVALSDIVVLRDLLKPLRDLNDATSLTKYLESFYTLRKPVASTINTLAGALYKVFSASPDQARKEMRQACFDYLSLGGIFSSGPVALLSGLNPRPLSLVMHFFAVAIYGVGRLLLPFPSPKSVWIGARLISSASGIIFPIIKAEGVRQMFFPATIPAIYRPPPVKDTSDDEQKSR

SEQ ID NO: 69 - protein, 444 aa, Artificial Sequence
  Amino acid sequence of S. cerevisiae ERG9
MGKLLQLALHPVEMKAALKLKFCRTPLFSIYDQSTSPYLLHCFELLNLTSRSFAAVIRELHPELRNCVTLFYLILRALDTIEDDMSIEHDLKIDLLRHFHEKLLLTKWSFDGNAPDVKDRAVLTDFESILIEFHKLKPEYQEVIKEITEKMGNGMADYILDENYNLNGLQTVHDYDVYCHYVAGLVGDGLTRLIVIAKFANESLYSNEQLYESMGLFLQKTNIIRDYNEDLVDGRSFWPKEIWSQYAPQLKDFMKPENEQLGLDCINHLVLNALSHVIDVLTYLAGIHEQSTFQFCAIPQVMAIATLALVFNNREVLHGNVKIRKGTTCYLILKSRTLRGCVEIFDYYLRDIKSKLAVQDPNFLKLNIQISKIEQFMEEMYQDKLPPNVKPNETPIFLKVKERSRYDDELVPTQQEEEYKFNMVLSIILSVLLGFYYIYTLHRA

SEQ ID NO: 70 - protein, 759 aa, Artificial Sequence
  Siraitia grosvenorii protein sequence or amino acid sequence of S. grosvenorli cucurbitadienol synthase
MWRLKVGAESVGENDEKWLKSISNHLGRQVWEFCPDAGTQQQLLQVHKARKAFHDDRFHRKQSSDLFITIQYGKEVENGGKTAGVKLKEGEEVRKEAVESSLERALSFYSSIQTSDGNWASDLGGPMFLLPGLVIALYVTGVLNSVLSKHHRQEMCRYVYNHQNEDGGWGLHIEGPSTMFGSALNYVALRLLGEDANAGAMPKARAWILDHGGATGITSWGKLWLSVLGVYEWSGNNPLPPEFWLFPYFLPFHPGRMWCHCRMVYLPMSYLYGKRFVGPITPIVLSLRKELYAVPYHEIDWNKSRNTCAKEDLYYPHPKMQDILWGSLHHVYEPLFTRWPAKRLREKALQTAMQHIHYEDENTRYICLGPVNKVLNLLCCWVEDPYSDAFKLHLQRVHDYLWVAEDGMKMQGYNGSQLWDTAFSIQAIVSTKLVDNYGPTLRKAHDFVKSSQIQQDCPGDPNVWYRHIHKGAWPFSTRDHGWLISDCTAEGLKAALMLSKLPSETVGESLERNRLCDAVNVLLSLQNDNGGFASYELTRSYPWLELINPAETFGDIVIDYPYVECTSATMEALTLFKKLHPGHRTKEIDTAIVRAANFLENMQRTDGSWYGCWGVCFTYAGWFGIKGLVAAGRTYNNCLAIRKACDFLLSKELPGGGWGESYLSCQNKVYTNLEGNRPHLVNTAWVLMALIEAGQAERDPTPLHRAARLLINSQLENGDFPQQEIMGVFNKNCMITYAAYRNIFPIWALGEYCHRVLTE

SEQ ID NO: 71 - protein, 764 aa, Artificial Sequence
  Cucurbitadienol synthase UniProtKB-Q6BE24
MWRLKVGAESVGEEDEKWVKSVSNHLGRQVWEFCADAAADTPHQLLQIQNARNHFHHNRFHRKQSSDLFLAIQYEKEIAKGAKGGAVKVKEGEEVGKEAVKSTLERALGFYSAVQTRDGNWASDLGGPLFLLPGLVIALHVTGVLNSVLSKHHRVEMCRYLYNHQNEDGGWGLHIEGTSTMFGSALNYVALRLLGEDADGGDGGAMTKARAWILERGGATAITSWGKLWLSVLGVYEWSGNNPLPPEFWLLPYSLPFHPGRMWCHCRMVYLPMSYLYGKRFVGPITPKVLSLRQELYTIPYHEIDWNKSRNTCAKEDLYYPHPKMQDILWGSIYHVYEPLFTRWPGKRLREKALQAAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPLSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 72 - protein, 764 aa, Artificial Sequence; identical to SEQ ID NO: 71
  Amino acid sequence of C. pepo cucurbitadienol synthase

SEQ ID NO: 73 - protein, 250 aa, Artificial Sequence
  C terminal portion of S. Grosvenorrii cucurbitadienol synthase
LERNRLCDAVNVLLSLQNDNGGFASYELTRSYPWLELINPAETFGDIVIDYPYVECTSATMEALTLFKKLHPGHRTKEIDTAIVRAANFLENMQRTDGSWYGCWGVCFTYAGWFGIKGLVAAGRTYNNCLAIRKACDFLLSKELPGGGWGESYLSCQNKVYTNLEGNRPHLVNTAWVLMALIEAGQAERDPTPLHRAARLLINSQLENGDFPQQEIMGVFNKNCMITYAAYRNIFPIWALGEYCHRVLTE

SEQ ID NO: 74 - DNA, 2280 bp, Artificial Sequence
  Codon optimized cucurbitadienol synthase from Siraitia grosvenorii
atgtggagattgaaagtaggtgctgaatccgtaggtgaaaacgacgaaaagtggttgaaaagtataagtaatcatttgggtagacaagtctgggaattttgtccagatgcaggtacacaacaacaattgttgcaagtacataaggctagaaaggcatttcatgatgacagattccacagaaagcaatcttcagatttgttcatcaccatccaatacggcaaggaagtagaaaacggtggcaagactgctggtgttaaattgaaggaaggtgaagaagttagaaaagaagcagttgaatccagtttggaaagagccttgtctttctactcttcaatccaaacctctgatggtaattgggcatcagacttgggtggtccaatgttcttgttacctggtttggtcattgccttgtacgtaactggtgttttgaactctgtattgtcaaagcatcacagacaagaaatgtgtagatacgtttacaaccatcaaaacgaagatggtggttggggtttgcacattgaaggtccatccactatgtttggtagtgcattgaattatgtcgccttaagattgttaggtgaagatgcaaacgccggtgctatgcctaaggcaagagcctggatattagaccatggtggtgctactggtatcacatcctggggtaaattgtggttaagtgtcttaggtgtatatgaatggtctggtaataacccattgccacctgaattttggttgttcccttactttttaccattccatcctggtagaatgtggtgtcactgcagaatggtttacttgccaatgtcttacttgtacggcaagagattcgttggtccaataacacctatcgtcttgtcattgagaaaggaattgtacgcagttccttaccatgaaatcgattggaacaagtccagaaacacctgtgctaaggaagatttgtattacccacaccctaaaatgcaagacattttgtggggtagtttacatcacgtttacgaaccattatttactagatggcctgctaaaagattgagagaaaaggcattacaaacagccatgcaacatatccactacgaagatgaaaacaccagatacatctgcttgggtccagttaacaaggtcttgaacttgttgtgttgctgggttgaagatccttattctgacgctttcaagttgcatttgcaaagagtacacgattacttgtgggttgcagaagacggtatgaaaatgcaaggttacaatggttcacaattgtgggatacagctttttccattcaagcaatagtcagtactaagttggtagataactacggtccaacattaagaaaagctcatgacttcgtaaagtccagtcaaatacaacaagattgtccaggtgaccctaatgtttggtatagacatatccacaaaggtgcatggccattttctaccagagatcatggttggttgatttcagactgtactgctgaaggtttgaaggctgcattgatgttgtctaagttgccatcagaaactgttggtgaatccttggaaagaaatagattatgcgatgccgttaacgtcttgttgagtttgcaaaacgacaacggtggtttcgcttcttacgaattgactagatcatacccatggttggaattaattaatcctgctgaaacattcggtgatatcgtcattgactatccatacgtagaatgtacctccgctactatggaagcattgaccttgttcaagaagttgcatcctggtcacagaacaaaggaaatcgataccgcaattgttagagccgctaatttcttggaaaacatgcaaagaacagacggttcttggtatggttgttggggtgtttgctttacctacgctggttggttcggtattaaaggtttagtcgcagccggtagaacatacaataactgtttggccataagaaaagcttgcgatttcttgttatctaaggaattaccaggtggtggttggggtgaatcctacttgagttgtcaaaacaaggtttacactaatttggaaggcaacagacctcatttagttaacacagcctgggtcttgatggctttaatcgaagccggtcaagctgaaagagatccaactcctttgcatagagctgcaagattgttgatcaactcacaattggaaaacggtgattttccacaacaagaaatcatgggtgttttcaacaagaactgcatgataacatatgccgcttacagaaacatttttcctatatgggctttgggtgaatactgccacagagtcttgaccgaataa

SEQ ID NO: 75 - protein, 757 aa, Artificial Sequence
  cycloartenol synthase
MWKLKIAEGGNPWLRSTNSHVGRQVWEFDPKLGSPQDLAEIETARNNFHDNRFSHKHSSDLLMRIQFSKENPIGEVLPKVKVKDVEDVTEEAVVTTLRRAISFHSTLQSHDGHWPGDYGGPMFLMPDLVITLSITGALNAVLTDEHRKEMCRYLYNHQNKDGGWGLHIEGPSTMFGSVLNYVTLRLLGEGPNDGQGDMEKARDWILGHGGATYITSWGKMWLSVLGVFEWSGNNPLPPEIWLLPYALPFHPGRMWCHCRMVYLPMSYLYGKRFVGPITPTILSLRKELFTIPYHDIDWNQARNLCAKEDLYYPHPLVQDILWASLHKVVEPVLMQWPGKKLREKAINSVMEHIHYEDENTRYICIGPVNKVLNMLCCWVEDPNSEAFKLHLPRIYDYLWIAEDGMKMQGYNGSQLWDTAFAAQAIISTNLIEEYGPTLRKAHTFIKNSQVLEDCPGDLNKWYRHISKGAWPFSTADHGWPISDCTAEGLKAILSLSKIAPDIVGEPLDAKRLYDAVNVILSLQNEDGGLATYELTRSYSWLELINPAETFGDIVIDYPYVECTSAAIQALTSFRKLYPGHRREEIQHSIEKAAAFIEKIQSSDGSWYGSWGVCFTYGTWFGVKGLIAAGKSFSNCSSIRKACEFLLSKQLPSGGWGESYLSCQNKVYSNLEGNRPHAVNTGWAMLALIEAEQAKRDPTPLHRAALYLINSQMENGDFPQQEIMGVFNKNCMITYAAYRSIFPIWALGEYRCRVLQAR

SEQ ID NO: 76 - protein, 763 aa, Artificial Sequence
  hypothetical protein
MWKLTIGAESVHDNGQSSSWLKSVNNHLGRQVWEFCPQLGSPDELLQLQNVRLSFQAQRFDKKHSADLLMRFQFEKENPCVNLPQIKVKDDEDVTEEAVTTTLRRAVNFYRKIQAHDGHWPGDYGGPMFLLPGLIITLSITGALNAVLSKEHQREMCRYLYNHQNRDGGWGLHIEGPSTMFGTCLNYVTLRLLGEGAEGGDGEMEKGRKWILDHGGATEITSWGKMWLSVLGVHEWSGNNPLPPEVWLCPYLLPMHPGRMWCHCRMVYLPMSYLYGKRFVGPITPTIQSLRKEIYTVPYHEVDWNTARNTCAKEDLYYPHPLVQDILWASLHYAYEPILTRWPLNRLREKALHKVMQHIHYEDENTQYICIGPVNKVLNMLCCWVEDPHSEAFKLHLPRVFDYLWIAEDGMKMQGYNGSQLWDTAFAVQAIVSTNLAEEYSGTLRKAHKYLKDSQVLEDCPGDLNFWYRHISKGAWPFSTADHGWPISDCTAEGLKAVLLLSKLPTEMVGDPLGVERLRDAVNVILSLQNADGGFATYELTRSYQWLELINPAETFGDIVIDYPYVECTSAAIQALASFKKLYPGHRREEIDNCIAEAANFIEKIQATDGSWYGSWGVCFTYAGWFGIKGLVAAGMTYNSSSSIRKACDYMLSKELAGGGWGESYLSCQNKVYTNLKDDRPHIVNTGWAMLALIEAGQAERDPIPLHRAARVLINSQMENGDFPQEEIMGVFNKNCMISYSAYRNIFPIWALGEYRCQVLQAL

SEQ ID NO: 77 - protein, 757 aa, Artificial Sequence
  putative 2,3 oxidosqualene cyclase
MWKLKIAEGEDPWLRSVNNHVGRQVWEFDRNLGTPEELIEVEKAREDFSNHKFEKKHSSDLLMRLQLAKENPCSIDLPRVQVKDTEEVTEEAVTTTLRRGLSFYSTIQGHDGHWPGDYGGPLFLMPGLVIALSVTGALNAVLSSEHQRETRRYIYNHQNEDGGWGLHIEGSSTMFITTLNYVTLRLLGEGADDGEGAMEKARKWILNHGSATATTSWGKMWLSVLGVFEWSGNNPLPPEMWLLPYCLPFHPGRMWCHCRMVYLPMSYLYGKRFVGPITPTIESLRKELYSVPYHEIDWNQARNLCAKEDLYYPHPLVQDILWTSLHYGVEPILTRWPANKLREKSLLTTMQHIHYEDENTRYICIGPVNKVLNMLCCWVEDPNSEAFKLHIPRIYDYLWVAEDGMKMQGYNGSQLWDTAFAVQAIISTNLFEDYAPTLRKAHKYIKDSQVLDDCPGDLNFWYRHISKGAWPFSTADHGWPISDCTAEGLKAALLLSKIPSKSVGDPINAKQLYDAVNVILSLQNGDGGFATYELTRSYPWLELINPAETFGDIVIDYPYVECTAAAIQALTSFKKLYPGHRREDIENCVEKAVKFLKEIQAPDGSWYGSWGVCFTYGIWFGIKGLVAAGETFTNSSSIRKACDFLLSKELDSGGWGESYLSCQNKVYTNLKGNRPHLVNTGWAMSALIDAGQAERDPKPLHRAARVLINSQMDNGDFPQEEIMGVFNRNCMISYSAYRNIFPIWALGEYRCRVLKAP

SEQ ID NO: 78 - protein, 714 aa, Artificial Sequence
  Produced by native host Bacillus macerans, AAA22298.1
MKSRYKRLTSLALSLSMALGISLPAWASPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTLTLITSRSDRLRPQPHVSGRAGTNPGFAENGALYDNGSLLGAYSNDTAGLFHHNGGTDFSTIEDGIYKNLYDLADINHNNNAMDAYFKSAIDLWLGMGVDGIRFDAVKQYPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTVRFLVNQANTNYGTNVYLVGNAAELGTWDPNKAIGPMYNQVIAKYPSWYYDVSVPAGTKLDFKFIKKGGGTVTWEGGGNHTYTTPASGVGTVTVDWQN

SEQ ID NO: 79 - protein, 726 aa, Artificial Sequence
  Produced by native host Bacillus macerans, 3WMS_A
MKYLLPTAAAGLLLLAAQPAMAMDIGINSDPSPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTAHAHNIKVVIDFAPNHTSPADRDNPGFAENGALYDNGSLLGAYSNDTAGLFHHNGGTDFSTIEDGIYKNLIDLADINHNNNAMDAYFKSAIDLWLGMGVDGIRFDAVKHMPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTMRFLVNQANTNYGTNVYLVGNAAELGSWDPNKAIGPMYNQVIAKYPSWYYDVSVPAGTKLDFKFIKKGGGTVTWEGGGNHTYTTPASSVGTVTVDWQNLEHHHHHH

SEQ ID NO: 80 - protein, 687 aa, Artificial Sequence
  Produced by native host Bacillus macerans, 4JCL_A
SPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTAHAHNIKVVIDFAPNHTSPADRDNPGFAENGGMYDNGSLLGAYSNDTAGLFHHNGGTDFSTIEDGIYKNLYDLADINHNNNAMDAYFKSAIDLWLGMGVDGIRFDAVKHMPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTVRFLVNQANTNYGTNVYLVGNAAELGSWDPNKAIGPMYNQVIAKYPSWYYDVSVPAGTKLDFKFIKKGGGTVTWEGGGNHTYTTPASGVGTVTVDWQN

SEQ ID NO: 81 - protein, 714 aa, Artificial Sequence
  WP_036618292.1
MKSRYKRLTSLALSLSMALGISLPAWASPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTAHAHNIKVVIDFAPNHTSPADRDNPGFAENGALYDNGSLLGAYSNDTAGLFHHNGGTDFSTIEDGIYKNLYDLADINHNNNAMDAYFKSAIDLWLGMGVDGIRFDAVKHMPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTVRFLVNQANTNYGTNVYLVGNAAELGSWDPNKAIGPMYNQVIAKYPSWYYDVSVPAGTKLDFKFIKKGGGTVTWEGGGNHTYTTPASGVGTVTVDWQN

SEQ ID NO: 82 - protein, 714 aa, Artificial Sequence
  P04830.2
MKSRYKRLTSLALSLSMALGISLPAWASPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTAHAHNIKVVIDFAPNHTSPADRDNPGFAENGGMYDNGSLLGAYSNDTAGLFHHNGGTDFSTIEDGIYKNLYDLADINHNNNAMDAYFKSAIDLWLGMGVDGIRFDAVKHMPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTVRFLVNQANTNYGTNVYLVGNAAELGSWDPNKAIGPMYNQVIAKYPSWYYDVSVPAGTKLDFKFIKKGGGTVTWEGGGNHTYTTPASGVGTVTVDWQN

SEQ ID NO: 83 - protein, 714 aa, Artificial Sequence; identical to SEQ ID NO: 81
  AAC04359.1

SEQ ID NO: 84 - protein, 714 aa, Artificial Sequence; identical to SEQ ID NO: 82
  CAA41773.1

SEQ ID NO: 85 - protein, 687 aa, Artificial Sequence
  AGT21379.1
SPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTAHAHNIKVVIDFAPNHTSPADRDNPGFAENGALYDNGSLLGAYSNDTAGLFHHNGGTDFSTIEDGIYKNLYDLADINHNNNAMDAYFKSAIDLWLGMGVDGIRFDAVKHMPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAAGGTAVWQYTAPETSPAIGNVGPTMGQPGNIVTIDGRGFGGTAGTVYFGTTAVTGSGIVSWEDTQIKAVIPKVAAGKTGVSVKTSSGTASNTFKSFNVLTGDQVTMRFLVNQANTNYGTNVYLVGNAAELGSWDPNKAIGPMYNQVIAKYPSWYYDVSVPAGTKLDFKFIKKGGGTVTWEGGGNHTYTTPASSVGTVTVDWQN

SEQ ID NO: 86 - protein, 687 aa, Artificial Sequence
  AGT95840.1 CGTase Amano
  VARIANT 485, 487: Xaa = Any Amino Acid
SPDTSVDNKVNFSTDVIYQIVTDRFADGDRTNNPAGDAFSGDRSNLKLYFGGDWQGIIDKINDGYLTGMGVTALWISQPVENITSVIKYSGVNNTSYHGYWARDFKQTNDAFGDFADFQNLIDTAHAHNIKVVIDFAPNHTSPADRDNPGFAENGALYDNGSLPGAYSNDTAGLFHHNGGTDFSTIEDGIYKNLYDLADINHNNNAMDAYFKSAIDLWLGMGVDGIRFDAVKHMPFGWQKSFVSSIYGGDHPVFTFGEWYLGADQTDGDNIKFANESGMNLLDFEYAQEVREVFRDKTETMKDLYEVLASTESQYDYINNMVTFIDNHDMDRFQVAGSGTRATEQALALTLTSRGVPAIYYGTEQYMTGDGDPNNRAMMTSFNTGTTAYKVIQALAPLRKSNPAIAYGTTTERWVNNDVLIIERKFGSSAALVAINRNSSAAYPISGLLSSLPAGTYSDVLNGLLNGNSITVGSGGAVTNFTLAXGXTAVWQYTAPETSPAIGDVGPTMGQPGNIVTIDGRGFGGTAGTVYFGTTAVTGSGIVSWEDTQIKAVIPKVAAGKTGVSVKTSSGTASNTFKSFNVLTGDQVTVRFLVNQANTNYGTNVYLVGNAAELDSWDPNKAIGPMYNQVIAKYPSWYYDVSVPAGTKLDFKFIKKGGGTVTWEGGGNHTYTTPASGVGTVTADWQN

SEQ ID NO: 87 - protein, 713 aa, Artificial Sequence
  P31835.1
MKKQVKWLTSVSMSVGIALGAALPVWASPDTSVNNKLNFSTDTVYQIVTDRFVDGNSANNPTGAAFSSDHSNLKLYFGGDWQGITNKINDGYLTGMGITALWISQPVENITAVINYSGVNNTAYHGYWPRDFKKTNAAFGSFTDFSNLIAAAHSHNIKVVMDFAPNHTNPASSTDPSFAENGALYNNGTLLGKYSNDTAGLFHHNGGTDFSTTESGIYKNLYDLADINQNNNTIDSYLKESIQLWLNLGVDGIRFDAVKHMPQGWQKSYVSSIYSSANPVFTFGEWFLGPDEMTQDNINFANQSGMHLLDFAFAQEIREVFRDKSETMTDLNSVISSTGSSYNYINNMVTFIDNHDMDRFQQAGASTRPTEQALAVTLTSRGVPAIYYGTEQYMTGNGDPNNRGMMTGFDTNKTAYKVIKALAPLRKSNPALAYGSTTQRWVNSDVYVYERKFGSNVALVAVNRSSTTAYPISGALTALPNGTYTDVLGGLLNGNSITVNGGTVSNFTLAAGGTAVWQYTTTESSPIIGNVGPTMGKPGNTITIDGRGFGTTKNKVTFGTTAVTGANIVSWEDTEIKVKVPNVAAGNTAVTVTNAAGTTSAAFNNFNVLTADQVTVRFKVNNATTALGQNVYLTGNVAELGNWTAANAIGPMYNQVEASYPTWYFDVSVPANTALQFKFIKVNGSTVTWEGGNNHTFTSPSSGVATVTVDWQN

SEQ ID NO: 88 - protein, 714 aa, Artificial Sequence; identical to SEQ ID NO: 81
  KFM94552.1

SEQ ID NO: 89 - protein, 710 aa, Artificial Sequence
  Toruzyme AJE25826.1
MKKTLKLLSILLITIALLFSTIPSVPAAPDTSVSNVVNYSTDVIYQIVTDRFLDGNPSNNPTGDLYDPTHTSLKKYFGGDWQGIINKINDGYLTGMGITAIWISQPVENIYAVLPDSTFGGSTSYHGYWARDFKKTNPFFGSFTDFQNLIATAHAHNIKVIIDFAPNHTSPASETDPTYGENGRLYDNGELLGGYTNDTNGYFHHYGGTNFSSYEDGIYRNLFDLADLDQQNNTIDSYLKAAIKLWLDMGIDGIRMDAVKHMAFGWQKNFMDSILSYRPVFTFGEWYLGTNEVDPNNTYFANESGMNLLDFRFAQKVRQVFRDNTDTMYGLDSMIQSTAADYNFINDMVTFIDNHDMDRFYTGGSTRPVEQALAFTLTSRGVPAIYYGTEQYMTGNGDPYNRAMMTSFNTNTTAYNVIKKLAPLRKSNPAIAYGTQKQRWVNNDVYIYERQFGNNVALIAINRNLSTSYNITGLYTALPAGTYSDVLGGLLNGNSITVSSNGSVTSFTLAPGAVAVWQYVSTTNPPLIGHVGPTMTKAGQTITIDGRGFGTTAGQVLFGTTPATIVSWEDTEVKVKVPALTPGKYNITLKTASEVTSNSYNNINVLTGNQVCVRFVVNNATTVWGENVYLTGNVAELGNWDTSKAIGPMFNQVVYQYPTWYYDVSVPAGTTIEFKFIKKNGSTVTWEGGYNHVYTTPTSGTATVIVNWQN

SEQ ID NO: 90 - protein, 526 aa, Artificial Sequence
  Toruzyme KHO62967.1
MRKNVKLFAAIILFFSLLLTSCGSKDTSSNITPKSDVIYQVMIDRFYNGDKSNDDPKISKGMFDPTYTNWRMYWGGDLKGLTEKIPYIKGMGVTAIWISPVVDNINKPAIYNGEINAPYHGYWARDFKRVEEHFGSWEDFDNFVKTAHANGIKVILDFAPNHTSPADKNNPDFAENGALYDDGNLLGTYSNDVNKLFHHNGGITNWNNLKDLQDKNLFDLADLDQSNPIVDKYLKDSIKLWFSHGIDGVRLDAVKHMPMEWVKSFADTIYGVNKDAILFGEWMLNGPTDPLYGYNIQFANTSGFSVLDFMLNSAIKDVFEKGYGFDRLNDTIEETNKDYDNPYKLVTFVDNHDMPRFLSVNDDKDKLHEAIAFIMTSRGIPAIYYGTEQYLHNDTNGGNDPYNRPMMEKFDENTTAYVLIRELSNLRKATQALQYGKTVSRYVSNDVYIYERQYGKDIVVVAINKGEETTVKNIETSLRKGKYSDYLKGLLKGGNLKVERGNSENDILSITLPKDSVSIWTNVKVK

SEQ ID NO: 91 - protein, 710 aa, Artificial Sequence
  Toruzyme KHO61869.1
MKKTLKLLSILLITIALLFSSIPSVPAAPDTSVSNVVNYSTDVIYQIVTDRFLDGNPNNNPTGDLYDPTHTSLKKYFGGDWQGIINKINDGYLTGMGITAIWISQPVENIYAVLPDSTFGGSTSYHGYWARDFKKTNPFFGSFTDFQNLIATAHAHNIKVIIDFAPNHTSPASETDPTYGENGRLYDNGVLLGGYTNDTNGYFHHYGGTNFSSYEDGIYRNLFDLADLDQQNNTIDSYLKAAIKLWLDMGIDGIRMDAVKHMAFGWQKNFMDSILSYRPVFTFGEWYLGTNEVDPNNTYFANESGMSLLDFRFAQKVRQVFRDNTDTMYGLDSMLQSTAADYNFINDMVTFIDNHDMDRFYTGGSTRPVEQALAFTLTSRGVPAIYYGTEQYMTGNGDPYNRAMMTSFDTTTTAYNVIKKLAPLRKSNPAIAYGTQKQRWINNDVYIYERQFGNNVALVAINRNLSTSYYITGLYTALPAGTYSDVLGGLLNGNNISVASDGSVTPFTLAPGEVAVWQYVSTTNPPLIGHVGPTMTKAGQTITIDGRGFGTTAGQVLFGTTPATIVSWEDTEVKVKVPALTPGKYNVTLKTASGVTSNSYNNINVLTGNQVCVRFVVNNASTVWGENVYLTGNVAELGSWDTSKAIGPMFNQVVYQYPTWYYDVSVPAGTTIEFKFIKKNGSTVTWEGGYNHVYTTPTSGTATVIVNWQN

SEQ ID NO: 92 - protein, 710 aa, Artificial Sequence
  Toruzyme KHO61665.1
MKKTLKLLSILLITIALLFSSIPSVPAAPDTSVSNVVNYSTDVIYQIVTDRFLDGNPSNNPTGDLYDPTHTSLKKYFGGDWQGIINKINDGYLTGMGITAIWISQPVENIYAVLPDSTFGGSTSYHGYWARDFKKTNPFFGSFTDFQNLIATAHAHNIKVIIDFAPNHTSPASETDPTYGENGRLYDNGVLLGGYTNDTNGYFHHYGGTNFSSYEDGIYRNLFDLADLDQQNNTIDSYLKVAIKLWLNMGIDGIRMDAVKHMAFGWQKNFMDSILSYRPVFTFGEWYLGTNEVDPNNTYFANESGMSLLDFRFAQKVRQVFRDNTDTMYGLDSMLQSTAADYNFINDMVTFIDNHDMDRFYTGGSTRPVEQALAFTLTSRGVPAIYYGTEQYMTGNGDPYNRAMMTSFDTTTTAYNVIKKLAPLRKSNPAIAYGTQKQRWINNDVYIYERQFGNNVALVAINRNLSTSYYITGLYTALPAGTYSDVLGGLLNGNNISVASDGSVTPFTLAPGEVAVWQYVSTTNPPLIGHVGPTMTKAGQTITIDGRGFGTTAGQVLFGTTPATIVSWEDTEVKVKVPALTPGKYNVTLKTASGVTSNSYNNINVLTGNQVCVRFVVNNASTVWGENVYLTGNVAELGSWDTSKAIGPMFNQVVYQYPTWYYDVSVPAGTTIEFKFIKKNGSTVTWEGGYNHVYTTPTSGTATVIVNWQN

SEQ ID NO: 93 - protein, 710 aa, Artificial Sequence; identical to SEQ ID NO: 91
  Toruzyme WP_042834654.1

SEQ ID NO: 94 - protein, 710 aa, Artificial Sequence; identical to SEQ ID NO: 92
  Toruzyme WP_042834464.1

SEQ ID NO: 95 - protein, 711 aa, Artificial Sequence
  Cyclomaltodextrin glucanotransferase
MRRWLSLVLSMSFVFSAIFIVSDTQKVTVEAAGNLNKVNFTSDVVYQIVVDRFVDGNTSNNPSGALFSSGCTNLRKYCGGDWQGIINKINDGYLTDMGVTAIWISQPVENVFSVMNDASGSASYHGYWARDFKKPNPFFGTLSDFQRLVDAAHAKGIKVIIDFAPNHTSPASETNPSYMENGRLYDNGTLLGGYTNDANMYFHHNGGTTFSSLEDGIYRNLFDLADLNHQNPVIDRYLKDAVKMWIDMGIDGIRMDAVKHMPFGWQKSLMDEIDNYRPVFTFGEWFLSENEVDANNHYFANESGMSLLDFRFGQKLRQVLRNNSDNWYGFNQMIQDTASAYDEVLDQVTFIDNHDMDRFMIDGGDPRKVDMALAVLLTSRGVPNIYYGTEQYMTGNGDPNNRKMMSSFNKNTRAYQVIQKLSSLRRNNPALAYGDTEQRWINGDVYVYERQFGKDVVLVAVNRSSSSNYSITGLFTALPAGTYTDQLGGLLDGNTIQVGSNGSVNAFDLGPGEVGVWAYSATESTPIIGHVGPMMGQVGHQVTIDGEGFGTNTGTVKFGTTAANVVSWSNNQIVVAVPNVSPGKYNITVQSSSGQTSAAYDNFEVLTNDQVSVRFVVNNATTNLGQNIYIVGNVYELGNWDTSKAIGPMFNQVVYSYPTWYIDVSVPEGKTIEFKFIKKDSQGNVTWESGSNHVYTTPTNTTGKIIVDWQN

SEQ ID NO: 96 - protein, 711 aa, Artificial Sequence; identical to SEQ ID NO: 95
  Cyclomaltodextrin glucanotransferase

SEQ ID NO: 97 - protein, 711 aa, Artificial Sequence; identical to SEQ ID NO: 95
  Cyclomaltodextrin glucanotransferase

SEQ ID NO: 98 - protein, 680 aa, Artificial Sequence
  Cyclodextrin Glucanotransferase
AGNLNKVNFTSDVVYQIVVDRFVDGNTSNNPSGALFSSGCTNLRKYCGGDWQGIINKINDGYLTDMGVTAIWISQPVENVFSVMNDASGSASYHGYWARDFKKPNPFFGTLSDFQRLVDAAHAKGIKVIIDFAPNHTSPASETNPSYMENGRLYDNGTLLGGYTNDANMYFHHNGGTTFSSLEDGIYRNLFDLADLNHQNPVIDRYLKDAVKMWIDMGIDGIRMDAVKHMPFGWQKSLMDEIDNYRPVFTFGEWFLSENEVDANNHYFANESGMSLLDFRFGQKLRQVLRNNSDNWYGFNQMIQDTASAYDEVLDQVTFIDNHDMDRFMIDGGDPRKVDMALAVLLTSRGVPNIYYGTEQYMTGNGDPNNRKMMSSFNKNTRAYQVIQKLSSLRRNNPALAYGDTEQRWINGDVYVYERQFGKDVVLVAVNRSSSSNYSITGLFTALPAGTYTDQLGGLLDGNTIQVGSNGSVNAFDLGPGEVGVWAYSATESTPIIGHVGPMMGQVGHQVTIDGEGFGTNTGTVKFGTTAANVVSWSNNQIVVAVPNVSPGKYNITVQSSSGQTSAAYDNFEVLTNDQVSVRFVVNNATTNLGQNIYIVGNVYELGNWDTSKAIGPMFNQVVYSYPTWYIDVSVPEGKTIEFKFIKKDSQGNVTWESGSNHVYTTPTNTTGKIIVDWQN

SEQ ID NO: 99 - protein, 711 aa, Artificial Sequence; identical to SEQ ID NO: 95
  Cyclodextrin Glucanotransferase

SEQ ID NO: 100 - protein, 364 aa, Artificial Sequence
  Hypothetical protein
MSRNGAVTPDWQFTVEVQEGETITYKYVKGGSWDQEGLADHTREDDNDDDVSYYGYGAIGTDLKVTVHNEGNNTMIVQDRILRWIDMPVVIEEVQKQGSQVTIKGNAIKNGVLTINGERVPIDGRMAFSYTFTPASHQKEVSIHIEPSAESKTAIFNNDGGAIAKNTKDYVLNLETKQLREGKLTTPPSNGDSPESDWPGSETPSHDGGATPGNGTSPGSGGPSDGTSPGGSVPPGGTAPPGNEAPPSRPPQKPSPSKPKEKPRKPTTPPGQVKKVYWDGVELKKGQIGRLTVQKPINLWKRTKDGRLVFVRILQPGEVYRVYGYDVRFGGQYAVGGGYYVTDIDTHIRYETPSKEKLKLVNGE

SEQ ID NO: 101 - protein, 364 aa, Artificial Sequence
  Maltodextrin glucosidase
MSRNGAVTPDWQFTVEVQEGETITYKYVKGGSWDQEGLADHTREDDNDDDVSYYGYGAIGTDLKVTVHNEGNNTMIVQDRILRWIDMPVVIEEVQKQGSQVTIKGNAIKNGVLTINGERVPIDGRMAFSYTFTPASHQKEVSIHIEPSAESKTAIFNNDGGAIAKNTKDYVLNLETKQLREGKLTTPPSNGDSPESDWPGSETPSHDGGATPGNGTSPGSGGPSDGTSPGGSVPPGGTAPPGNGAPPSAPPQKPSPSKPKEKPRKPTTPPSQVKKVYWDGVELKKGQIGRLTVQKPINLWKRAKDGRLVFVRILQPGEVYRVYGYDARFGGQYAVGGGYYVTDIDTHIRYETPSKEKLKLVNGE

SEQ ID NO: 102 - protein, 542 aa, Artificial Sequence
  Beta-glucosidase
MAMQLRSLLLCVLLLLLGFALADTNAAARIHPPVVCANLSRANFDTLVPGFVFGAATASYQVEGAANLDGRGPSIWDTFTHKHPEKIADGSNGDVAIDQYHRYKEDVAIMKDMGLESYRFSISWSRVLPNGTLSGGINKKGIEYYNNLINELLHNGIEPLVTLFHWDVPQTLEDEYGGFLSNRIVNDFEEYAELCFKKFGDRVKHWTTLNEPYTFSSHGYAKGTHAPGRCSAWYNQTCFGGDSATEPYLVTHNLLLAHAAAVKLYKTKYQAYQKGVIGITVVTPWFEPASEAKEDIDAVFRALDFIYGWFMDPLTRGDYPQSMRSLVGERLPNFTKKESKSLSGSFDYIGINYYSARYASASKNYSGHPSYLNDVNVDVKTELNGVPIGPQAASSWLYFYPKGLYDLLCYTKEKYNDPIIYITENGVDEFNQPNPKLSLCQLLDDSNRIYYYYHHLCYLQAAIKEGVKVKGYFAWSLLDNFEWDNGYTVRFGINYVDYDNGLKRHSKHSTHWFKSFLKKSSRNTKKIRRCGNNNTSATKFVF

SEQ ID NO: 103 - protein, 1381 aa, Artificial Sequence; identical to SEQ ID NO: 2
  DexT Native host Leuconostoc citreum ATCC 11449

SEQ ID NO: 104 - DNA, 4146 bp, Artificial Sequence
  DexT DNA
atgccagcaaatgccccagataaacaatcagtgactaatgcaccagtagtgccgccaaagcatgatacggaccagcaggacgattcactagaaaaacagcaagtattagaaccgagcgtaaatagtaatataccaaaaaagcagacaaatcaacagttagcggttgttacagcaccagcaaattcagcacctcaaaccaaaacaacagcagaaatttctgctggtacagagttagacacgatgcctaatgttaagcatgtagatggcaaagtttatttttatggagatgatggccaaccaaaaaagaattttactactattatagatggtaaaccttactactttgataaagatacaggggcactatctaataacgataagcaatatgtatcggaattattcagtattggcaataaacataacgccgtctataacacatcatcagataattttacgcaattagaaggacatctgacggcaagtagttggtatcgtccaaaagatattttgaaaaatggtaaacgttgggcaccttcaacagtgactgatttcagaccattattgatggcctggtggccggataagagtacgcaagtcacttatctgaattacatgaaagatcagggcctcttgtctggtactcatcacttttccgataatgaaaatatgcggaccttaacggcagctgccatgcaggcacaggtaaacattgagaaaaaaattgggcaacttggcaatacggattggttgaaaacggcgatgacgcaatacattgatgcccagcccaattggaatattgacagtgaggcgaaaggagatgatcatctacaaggtggtgcactactttatacaaatagtgatatgtcgccaaaggccaattctgattatcgtaagctgagccgtacgcctaaaaatcaaaaaggtcaaattgctgataaatataagcaaggtgggtttgaattattactagcaaacgatgtcgataattctaatccagttgtgcaagcagaacaacttaattggttacattatatgatgaatatcggtagtattttacaaaatgatgaccaagctaattttgatggttaccgtgttgatgctgtcgataatgtggacgctgacttactacagattgctggtgaatatgctaaggctgcctatggtgttgacaaaaatgacgcgagagcgaatcaacatttatcaattttggaagactggggagatgaagatccagactatgtcaaagcacatggcaaccagcaaattacaatggatttccccttgcatttagcgattaaatacgcgctcaacatgcctaatgataagcggagtggccttgagccaacccgtgaacacagtttagtcaaacgaattacagatgataaagaaaatgttgcacaaccaaattattcatttatccgagctcatgacagtgaagtacaaacgattattgctgatattattaaagataaaatcaacccggcgtcaacagggctagattcaacagtgactttggatcaaattaagcaggcttttgacatctataatgctgatgaattgaaagcagataaagtttacacaccttacaatattccagcatcatacgctttgttattgactaataaagacacaattccacgtgtttattatggggatatgttcacggatgatggccaatacatggctaaacaatcaccttactatcaagcgattgatgcgttgttgaaagctcgtatcaagtatgctgctggtggtcaaaccatgaaaatgaactattttccagatgaacaatctgttatgacatcagttcgttatggtaagggtgcaatgacggcaagtgactctggtaaccaagagacacgctatcaaggtattggacttgttgtcaacaatcgcccagatttgaaactatctgacaaagatgaagtcaaaatggatatgggtgcggcacataaaaaccaagattatcgcccagttttgttgacgacaaaatcaggattaaaagtctacagcactgatgcaaatgcacctgtcgttcgaactgacgccaatggccaattaacttttaaggcagacatggtatatggtgtaaacgacccacaagtgtcagggtacattgcggcttgggtaccagtaggggcttcagaaaatcaagatgctcgaacgaaaagtgaaacaacgcagtcaactgacgggagtgtttatcattctaatgcagcgttagattcgcaagtcatttatgaaggcttttcaaattttcaagactttccaacaacacccgatgagtttacgaacattaaaattgctcaaaatgttaacttatttaaggattggggtattactagctttgaaatggcgccacaatatcgcgccagctcagataaaagtttcttagatgctatcgtacaaaatggttatgcatttacagatcgatatgatattggttacaacacaccaacaaagtatgggacagcagataatttgttagatgctttacgtgcattgcatggtcagggtattcaagcgattaacgactgggtaccagatcaaatttataatctacccgatgaacagttagtcacggctattcgaacagacggttcaggtgatcatacttatggttcagttattgaccatactttgtatgcatcaaagacagttggcgggggcatttatcagcaacaatatggtggggccttcttggaacaattaaaaacacagtacccgcaacttttccagcaaaaacagatttccacagatcagccaatgaacccagatattcaaattaagtcatgggaagccaagtatttcaacggttcgaacattcaggggcgtggggcttggtatgttttgaaggactggggcacacaacagtattttaatgtgtcagatgcgcagaccttccttccaaagcaattattgggtgaaaaggccaaaactggttttgttacgcgtggtaaggagacttcattctattccactagtggctatcaagcaaaatctgcctttatttgtgataacggtaattggtactactttgatgacaaagggaaaatggttgttggaaaccaagttatcaatggcatcaattattactttttaccgaatggtatcgaattacaagatgcctatctagtacatgatggtatgtactattattataataatattggcaagcaactgcacaacacatattaccaagataaacaaaaaaatttccattacttctttgaagatgggcacatggcacagggtattgtcaccatcattcaaagtgatggcaccccagtcacacagtactttgatgagaatggtaagcaacaaaaaggcgtggcggtcaaaggatcagatggtcatttgcattactttgacggtgcgtcagggaatatgctctttaaatcatggggtagactagcagatggctcttggctatatgtagacgagaaaggtaatgcggttacaggcaaacaaaccattaataatcaaacggtttactttaatgatgatggtcgtcaaatcaaaaataactttaaagaattagcagatggttcttggctttatcttaacaataaaggtgttgcagtaacaggagagcaaataattaatgggcagacactttattttggtaacgatggtcgtcaatttaaagggacaacacatataaatgctactggtgaaagccgttactatgacccagactcaggtaatatgataactgatcgttttgaacgtgttggtgataatcaatgggcttattttggttatgatggtgttgcagtaacaggggaccgaatcattaaagggcaaaaactctatttcaaccaaaatggtatccaaatgaaaggccacttacgtcttgaaaatggtatcatgcgttattacgatgctgatactggcgaattagttcgtaatcgatttgtattgctatctgatggttcatgggtttactttggccaagatggcgtacccgtaactggcgtgcaagtgattaatggccaaacattatattttgacgcagatggtaggcaagtcaaagggcagcaacgtgtaatcggcaatcaacgctattggatggataaagacaatggtgaaatgaaaaaaataacatacgcggccgcactcgagcaccaccaccaccaccactga

SEQ ID NO: 105 - DNA, 4530 bp, Artificial Sequence
  DexT DNA
atgcaaaacggcgaagtgtgtcagcgtaaaaaactgtacaagtcagggaagatattagttacagcaagtatttttgctgttatgggttttggtactgccatgtcacaagcaaacgcgagcagtagtgataatgatagcaaaacacaaactatttcaaaaatagtaaaaagtaaagtcgaaccggcaactgttcaaccagcgaaaccagcggaacctactaataaaatagttgaccaagcagatatgcatacggtcagcgggcaaaacagcgtgccaccagtagtgactaatcaatccaattaacaggctgcaaaaccaactacacctgttaccgatgtcacagatacgcataaaatcgaagcaaacaacgtccctgctgatgttatgccagcaaatgccccagataaacaatcagtgactaatgcaccagtagtgccgccaaagcatgatacggaccagcaggacgattcactagaaaaacagcaagtattagaaccgagcgtaaatagtaatataccaaaaaagcagacaaatcaacagttagcggttgttacagcaccagcaaattcagcacctcaaaccaaaacaacagcagaaatttctgctggtacagagttagacacgatgcctaatgttaagcatgtagatggcaaagtttatttttatggagatgatggccaaccaaaaaagaattttactactattatagatggtaaaccttactactttgataaagatacaggggcactatctaataacgataagcaatatgtatcggaattattcagtattggcaataaacataacgccgtctataacacatcatcagataattttacgcaattagaaggacatctgacggcaagtagttggtatcgtccaaaagatattttgaaaaatggtaaacgttgggcaccttcaacagtgactgatttcagaccattattgatggcctggtggccggataagagtacgcaagtcacttatctgaattacatgaaagatcagggcctcttgtctggtactcatcacttttccgataatgaaaatatgcggaccttaacggcagctgccatgcaggcacaggtaaacattgagaaaaaaattgggcaacttggcaatacggattggttgaaaacggcgatgacgcaatacattgatgcccagcccaattggaatattgacagtgaggcgaaaggagatgatcatctacaaggtggtgcactactttatacaaatagtgatatgtcgccaaaggccaattctgattatcgtaagctgagccgtacgcctaaaaatcaaaaaggtcaaattgctgataaatataagcaaggtgggtttgaattattactagcaaacgatgtcgataattctaatccagttgtgcaagcagaacaacttaattggttacattatatgatgaatatcggtagtattttacaaaatgatgaccaagctaattttgatggttaccgtgttgatgctgtcgataatgtggacgctgacttactacagattgctggtgaatatgctaaggctgcctatggtgttgacaaaaatgacgcgagagcgaatcaacatttatcaattttggaagactggggagatgaagatccagactatgtcaaagcacatggcaaccagcaaattacaatggatttccccttgcatttagcgattaaatacgcgctcaacatgcctaatgataagcggagtggccttgagccaacccgtgaacacagtttagtcaaacgaattacagatgataaagaaaatgttgcacaaccaaattattcatttatccgagctcatgacagtgaagtacaaacgattattgctgatattattaaagataaaatcaacccggcgtcaacagggctagattcaacagtgactttggatcaaattaagcaggcttttgacatctataatgctgatgaattgaaagcagataaagtttacacaccttacaatattccagcatcatacgctttgttattgactaataaagacacaattccacgtgtttattatggggatatgttcacggatgatggccaatacatggctaaacaatcaccttactatcaagcgattgatgcgttgttgaaagctcgtatcaagtatgctgctggtggtcaaaccatgaaaatgaactattttccagatgaacaatctgttatgacatcagttcgttatggtaagggtgcaatgacggcaagtgactctggtaaccaagagacacgctatcaaggtattggacttgttgtcaacaatcgcccagatttgaaactatctgacaaagatgaagtcaaaatggatatgggtgcggcacataaaaaccaagattatcgcccagttttgttgacgacaaaatcaggattaaaagtctacagcactgatgcaaatgcacctgtcgttcgaactgacgccaatggccaattaacttttaaggcagacatggtatatggtgtaaacgacccacaagtgtcagggtacattgcggcttgggtaccagtaggggcttcagaaaatcaagatgctcgaacgaaaagtgaaacaacgcagtcaactgacgggagtgtttatcattctaatgcagcgttagattcgcaagtcatttatgaaggcttttcaaattttcaagactttccaacaacacccgatgagtttacgaacattaaaattgctcaaaatgttaacttatttaaggattggggtattactagctttgaaatggcgccacaatatcgcgccagctcagataaaagtttcttagatgctatcgtacaaaatggttatgcatttacagatcgatatgatattggttacaacacaccaacaaagtatgggacagcagataatttgttagatgctttacgtgcattgcatggtcagggtattcaagcgattaacgactgggtaccagatcaaatttataatctacccgatgaacagttagtcacggctattcgaacagacggttcaggtgatcatacttatggttcagttattgaccatactttgtatgcatcaaagacagttggcgggggcatttatcagcaacaatatggtggggccttcttggaacaattaaaaacacagtacccgcaacttttccagcaaaaacagatttccacagatcagccaatgaacccagatattcaaattaagtcatgggaagccaagtatttcaacggttcgaacattcaggggcgtggggcttggtatgttttgaaggactggggcacacaacagtattttaatgtgtcagatgcgcagaccttccttccaaagcaattattgggtgaaaaggccaaaactggttttgttacgcgtggtaaggagacttcattctattccactagtggctatcaagcaaaatctgcctttatttgtgataacggtaattggtactactttgatgacaaagggaaaatggttgttggaaaccaagttatcaatggcatcaattattactttttaccgaatggtatcgaattacaagatgcctatctagtacatgatggtatgtactattattataataatattggcaagcaactgcacaacacatattaccaagataaacaaaaaaatttccattacttctttgaagatgggcacatggcacagggtattgtcaccatcattcaaagtgatggcaccccagtcacacagtactttgatgagaatggtaagcaacaaaaaggcgtggcggtcaaaggatcagatggtcatttgcattactttgacggtgcgtcagggaatatgctctttaaatcatggggtagactagcagatggctcttggctatatgtagacgagaaaggtaatgcggttacaggcaaacaaaccattaataatcaaacggtttactttaatgatgatggtcgtcaaatcaaaaataactttaaagaattagcagatggttcttggctttatcttaacaataaaggtgttgcagtaacaggagagcaaataattaatgggcagacactttattttggtaacgatggtcgtcaatttaaagggacaacacatataaatgctactggtgaaagccgttactatgacccagactcaggtaatatgataactgatcgttttgaacgtgttggtgataatcaatgggcttattttggttatgatggtgttgcagtaacaggggaccgaatcattaaagggcaaaaactctatttcaaccaaaatggtatccaaatgaaaggccacttacgtcttgaaaatggtatcatgcgttattacgatgctgatactggcgaattagttcgtaatcgatttgtattgctatctgatggttcatgggtttactttggccaagatggcgtacccgtaactggcgtgcaagtgattaatggccaaacattatattttgacgcagatggtaggcaagtcaaagggcagcaacgtgtaatcggcaatcaacgctattggatggataaagacaatggtgaaatgaaaaaaataacatacgcggccgcactcgagcaccaccaccaccaccactga

SEQ ID NO: 106 - protein, 1455 aa, Artificial Sequence
  Dextransucrase
MEKKVRFKLRKVKKRWVTVSVASAVVTLTSLSGSLVKADSTDDRQQAVTESQASLVTTSEAAKETLTATDTSTATSATSQPTATVTDNVSTTNQSTNTTANTANFDVKPTTTSEQSKTDNSDKIIATSKAVNRLTATGKFVPANNNTAHSRTVTDKIVPIKPKIGKLKQPSSLSQDDIAALGNVKNIRKVNGKYYYYKEDGTLQKNYALNINGKTFFFDETGALSNNTLPSKKGNITNNDNTNSFAQYNQVYSTDAANFEHVDHYLTAESWYRPKYILKDGKTWTQSTEKDFRPLLMTWWPDQETQRQYVNYMNAQLGIHQTYNTATSPLQLNLAAQTIQTKIEEKITAEKNTNWLRQTISAFVKTQSAWNSDSEKPFDDHLQKGALLYSNNSKLTSQANSNYRILNRTPTNQTGKKDPRYTADRTIGGYEFLLANDVDNSNPVVQAEQLNWLHFLMNFGNIYANDPDANFDSIRVDAVDNVDADLLQIAGDYLKAAKGIHKNDKAANDHLSILEAWSYNDTPYLHDDGDNMINMDNRLRLSLLYSLAKPLNQRSGMNPLITNSLVNRTDDNAETAAVPSYSFIRAHDSEVQDLIRNIIRAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKATDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYALPEKEVVTATRVDKYGTPVAGSQIKNTLYVVDGKSSGKDQQAKYGGAFLEELQAKYPELFARKQISTGVPMDPSVKIKQWSAKYFNGTNILGRGAGYVLKDQATNTYFSLVSDNTFLPKSLVNPNHGTSSSVTGLVFDGKGYVYYSTSGNQAKNAFISLGNNWYYFDNNGYMVTGAQSINGANYYFLSNGIQLRNAIYDNGNKVLSYYGNDGRRYENGYYLFGQQWRYFQNGIMAVGLTRIHGAVQYFDASGFQAKGQFITTADGKLRYFDRDSGNQISNRFVRNSKGEWFLFDHNGVAVTGTVTFNGQRLYFKPNGVQAKGEFIRDADGHLRYYDPNSGNEVRNRFVRNSKGEWFLFDHNGIAVTGTRVVNGQRLYFKSNGVQAKGELITERKGRIKYYDPNSGNEVRNRYVRTSSGNWYYFGNDGYALIGWHVVEGRRVYFDENGVYRYASHDQRNHWDYDYRRDFGRGSSSAVRFRHSRNGFFDNFFRF

SEQ ID NO: 107 - protein, 1476 aa, Artificial Sequence
  Dextransucrase
MDKKVRYKLRKVKKRWVTVSVASAVMTLTTLSGGLVKADSNESKSQISNDSNTSVVTANEESNVTTEVTSKQEAASSQTNHTVTTISSSTSVVNPKEVVSNPYTVGETASNGEKLQNQTTTVDKTSEAAANNISKQTTEADTDVIDDSNAANLQILEKLPNVKEIDGKYYYYDNNGKVRTNFTLIADGKILHFDETGAYTDTSIDTVNKDIVTTRSNLYKKYNQVYDRSAQSFEHVDHYLTAESWYRPKYILKDGKTWTQSTEKDFRPLLMTWWPSQETQRQYVNYMNAQLGINKTYDDTSNQLQLNIAAATIQAKIEAKITTLKNTDWLRQTISAFVKTQSAWNSDSEKPFDDHLQNGAVLYDNEGKLTPYANSNYRILNRTPTNQTGKKDPRYTADNTIGGYEFLLANDVDNSNPVVQAEQLNWLHFLMNFGNIYANDPDANFDSIRVDAVDNVDADLLQIAGDYLKAAKGIHKNDKAANDHLSILEAWSDNDTPYLHDDGDNMINMDNKLRLSLLFSLAKPLNQRSGMNPLITNSLVNRTDDNAETAAVPSYSFIRAHDSEVQDLIRDIIKAEINPNVVGYSFTMEEIKKAFEIYNKDLLATEKKYTHYNTALSYALLLTNKSSVPRVYYGDMFTDDGQYMAHKTINYEAIETLLKARIKYVSGGQAMRNQQVGNSEIITSVRYGKGALKATDTGDRTTRTSGVAVIEGNNPSLRLKASDRVVVNMGAAHKNQAYRPLLLTTDNGIKAYHSDQEAAGLVRYTNDRGELIFTAADIKGYANPQVSGYLGVWVPVGAAADQDVRVAASTAPSTDGKSVHQNAALDSRVMFEGFSNFQAFATKKEEYTNVVIAKNVDKFAEWGVTDFEMAPQYVSSTDGSFLDSVIQNGYAFTDRYDLGISKPNKYGTADDLVKAIKALHSKGIKVMADWVPDQMYAFPEKEVVTATRVDKFGKPVEGSQIKSVLYVADSKSSGKDQQAKYGGAFLEELQAKYPELFARKQISTGVPMDPSVKIKQWSAKYFNGTNILGRGAGYVLKDQATNTYFNISDNKEINFLPKTLLNQDSQVGFSYDGKGYVYYSTSGYQAKNTFISEGDKWYYFDNNGYMVTGAQSINGVNYYFLSNGLQLRDAILKNEDGTYAYYGNDGRRYENGYYQFMSGVWRHFNNGEMSVGLTVIDGQVQYFDEMGYQAKGKFVTTADGKIRYFDKQSGNMYRNRFIENEEGKWLYLGEDGAAVTGSQTINGQHLYFRANGVQVKGEFVTDRYGRISYYDSNSGDQIRNRFVRNAQGQWFYFDNNGYAVTGARTINGQHLYFRANGVQVKGEFVTDRHGRISYYDGNSGDQIRNRFVRNAQGQWFYFDNNGYAVTGARTINGQHLYFRANGVQVKGEFVTDRYGRISYYDSNSGDQIRNRFVRNAQGQWFYFDNNGYAVTGARTINGQHLYFRANGVQVKGEFVTDRYGRISYYDANSGERVRIN

SEQ ID NO: 108 - protein, 1462 aa, Artificial Sequence
  Glucosyltransferase-S
METKRRYKMYKVKKHWVTIAVASGLITLGTTTLGSSVSAETEQQTSDKVVTQKSEDDKAASESSQTDAPKTKQAQTEQTQAQSQANVADTSTSITKETPSQNITTQANSDDKTVTNTKSEEAQTSEERTKQAEEAQATASSQALTQAKAELTKQRQTAAQENKNPVDLAAIPNVKQIDGKYYYIGSDGQPKKNFALTVNNKVLYFDKNTGALTDTSQYQFKQGLTKLNNDYTPHNQIVNFENTSLETIDNYVTADSWYRPKDILKNGKTWTASSESDLRPLLMSWWPDKQTQIAYLNYMNQQGLGTGENYTADSSQESLNLAAQTVQVKIETKISQTQQTQWLRDIINSFVKTQPNWNSQTESDTSAGEKDHLQGGALLYSNSDKTAYANSDYRLLNRTPTSQTGKPKYFEDNSSGGYDFLLANDIDNSNPVVQAEQLNWLHYLMNYGSIVANDPEANFDGVRVDAVDNVNADLLQIASDYLKAHYGVDKSEKNAINHLSILEAWSDNDPQYNKDTKGAQLPIDNKLRLSLLYALTRPLEKDASNKNEIRSGLEPVITNSLNNRSAEGKNSERMANYIFIRAHDSEVQTVIAKIIKAQINPKTDGLTFTLDELKQAFKIYNEDMRQAKKKYTQSNIPTAYALMLSNKDSITRLYYGDMYSDDGQYMATKSPYYDAIDTLLKARIKYAAGGQDMKITYVEGDKSHMDWDYTGVLTSVRYGTGANEATDQGSEATKTQGMAVITSNNPSLKLNQNDKVIVNMGTAHKNQEYRPLLLTTKDGLTSYTSDAAAKSLYRKTNDKGELVFDASDIQGYLNPQVSGYLAVWVPVGASDNQDVRVAASNKANATGQVYESSSALDSQLIYEGFSNFQDFVTKDSDYTNKKIAQNVQLFKSWGVTSFEMAPQYVSSEDGSFLDSIIQNGYAFEDRYDLAMSKNNKYGSQQDMINAVKALHKSGIQVIADWVPDQIYNLPGKEVVTATRVNDYGEYRKDSEIKNTLYAANTKSNGKDYQAKYGGAFLSELAAKYPSIFNRTQISNGKKIDPSEKITAWKAKYFNGTNILGRGVGYVLKDNASDKYFELKGNQTYLPKQMTNKEASTGFVNDGNGMTFYSTSGYQAKNSFVQDAKGNWYYFDNNGHMVYGLQHLNGEVQYFLSNGVQLRESFLENADGSKNYFGHLGNRYSNGYYSFDNDSKWRYFDASGVMAVGLKTINGNTQYFDQDGYQVKGAWITGSDGKKRYFDDGSGNMAVNRFANDKNGDWYYLNSDGIALVGVQTINGKTYYFGQDGKQIKGKIITDNGKLKYFLANSGELARNIFATDSQNNWYYFGSDGVAVTGSQTIAGKKLYFASDGKQVKGSFVTYNGKVHYYHADSGELQVNRFEADKDGNWYYLDSNGEALTGSQRINGQRVFFTREGKQVKGDVAYDERGLLRYYDKNSGNMVYNKVVTLANGRRIGIDRWGIARYY

SEQ ID NO: 109 - protein, 1431 aa, Artificial Sequence
  Dextransucrase
METKRRYKMHKVKKHWVTVAVASGLITLGTTTLGSSVSAETEQQTSDKVVTQKSEDDKAASESSQTDAPKTKQAQTEQTQAQSQANVADTSTSITKETPSQNITTQANSDDKTVTNTKSEEAQTSEERTKQSEEAQTTASSQALTQAKAELTKQRQTAAQENKNPVDLAAIPNVKQIDGKYYYIGSDGQPKKNFALTVNNKVLYFDKNTGALTDTSQYQFKQGLTKLNNDYTPHNQIVNFENTSLETIDNYVTADSWYRPKDILKNGKTWTASSESDLRPLLMSWWPDKQTQIAYLNYMNQQGLGTGENYTADSSQESLNLAAQTVQVKIETKISQTQQTQWLRDIINSFVKTQPNWNSQTESDTSAGEKDHLQGGALLYSNSDKTAYANSDYRLLNRTPTSQTGKPKYFEDNSSGGYDFLLANDIDNSNPVVQAEQLNWLHYLMNYGSIVANDPEANFDGVRVDAVDNVNADLLQIASDYLKAHYGVDKSEKNAINHLSILEAWSDNDPQYNKDTKGAQLPIDNKLRLSLLYALTRPLEKDASNKNEIRSGLEPVITNSLNNRSAEGKNSERMANYIFIRAHDSEVQTVIAKIIKAQINPKTDGLTFTLDELKQAFKIYNEDMRQAKKKYTQSNIPTAYALMLSNKDSITRLYYGDMYSDDGQYMATKSPYYDAIDTLLKARIKYAAGGQDMKITYVEGDKSHMDWDYTGVLTSVRYGTGANEATDQGSEATKTQGMAVITSNNPSLKLNQNDKVIVNMGAAHKNQEYRPLLLTTKDGLTSYTSDAAAKSLYRKTNDKGELVFDASDIQGYLNPQVSGYLAVWVPVGASDNQDVRVAASNKANATGQVYESSSALDSQLIYEGFSNFQDFVTKDSDYTNKKIAQNVQLFKSWGVTSFEMAPQYVSSEDGSFLDSIIQNGYAFEDRYDLAMSKNNKYGSQQDMINAVKALHKSGIQVIADWVPDQIYNLPGKEVVTATRVNDYGEYRKDSEIKNTLYAANTKSNGKDYQAKYGGAFLSELAAKYPSIFNRTQISNGKKIDPSEKITAWKAKYFNGTNILGRGVGYVLKDNASDKYFELKGNQTYLPKQMTNKEASTGFVNDGNGMTFYSTSGYQAKNSFVQDAKGNWYYFDNNGHMVYGLQQLNGEVQYFLSNGVQLRESFLENADGSKNYFGHLGNRYSNGYYSFDNDSKWRYFDASGVMAVGLKTINGNTQYFDQDGYQVKGAWITGSDGKKRYFDDGSGNMAVNRFANDKNGDWYYLNSDGIALVGVQTINGKTYYFGQDGKQIKGKIITDNGKLKYFLANSGELARNIFATDSQNNWYYFGSDGVAVTGSQTIAGKKLYFASDGKQVKGSFVTYNGKVHYYHADSGELQVNRFEADKDGNWYYLDSNGEALTGSQRINDQRVFFTREGKQVKGDVAYDERGLLRYYD

SEQ ID NO: 110 - protein, 595 aa, Artificial Sequence
  Hydrolyis of hyper-glycosylated Mogrosides from DexT reaction Dextranase
MFSAVLLGWLLFQPTVGHAIRQRAGNHTVCNSQLCTWWHDNGEINTASMVQLGNVRQSHKYLVQVSIAGVNDFYDSFAYESIPRNGRGRIYSPWDPPNSDTLGSDVDDGITIETSAGINMAWSQFEYSTGVDVKILTRDGSRLPDPSGVKIRPTAISYDIRSSSDGGIVIRVPHDPNGRRFSVEFDNDLYTYRSDGSRYVSSGGSIVGVEPRNALVIFASPFLPDNMVPRIDGPDTKVMTPGPINQGDWGSSGILYFPPGVYWMNSNQQGQTPKIGENHIRLHPNTYWAYLAPGAYVKGAIEYSTKSDFYATGHGVLSGEHYVYQANPATYYQALKSDATSLRMWWHNNLGGGQTWYCQGPTINAPPFNTMDFHGSSDITTRISDYKQVGAFFFQTDGPQMYPNSQVHDVFYHVNDDAIKTYYSGVTVTRATIWKAHNDPIIQMGWDTRDVTGVTLQDLYIIHTRYIKSETYVPSAIIGASPFYMPGRSVDPAKSISMTISNLVCEGLCPALMRITPLQNYRDFRIQNVAFPDGLQANSIGTGKSIVPASSGLKFGVAISNWTVGGEQVTMSNFQSDSLGQLDIDVSYWGQWVIR

SEQ ID NO: 111 - protein, 731 aa, Artificial Sequence
  Amino acid sequence of S. cerevisiae lanosterol synthase
MTEFYSDTIGLPKTDPRLWRLRTDELGRESWEYLTPQQAANDPPSTFTQWLLQDPKFPQPHPERNKHSPDFSAFDACHNGASFFKLLQEPDSGIFPCQYKGPMFMTIGYVAVNYIAGIEIPEHERIELIRYIVNTAHPVDGGWGLHSVDKSTVFGTVLNYVILRLLGLPKDHPVCAKARSTLLRLGGAIGSPHWGKIWLSALNLYKWEGVNPAPPETWLLPYSLPMHPGRWWVHTRGVYIPVSYLSLVKFSCPMTPLLEELRNEIYTKPFDKINFSKNRNTVCGVDLYYPHSTTLNIANSLVVFYEKYLRNRFIYSLSKKKVYDLIKTELQNTDSLCIAPVNQAFCALVTLIEEGVDSEAFQRLQYRFKDALFHGPQGMTIMGTNGVQTWDCAFAIQYFFVAGLAERPEFYNTIVSAYKFLCHAQFDTECVPGSYRDKRKGAWGFSTKTQGYTVADCTAEAIKAIIMVKNSPVFSEVHHMISSERLFEGIDVLLNLQNIGSFEYGSFATYEKIKAPLAMETLNPAEVFGNIMVEYPYVECTDSSVLGLTYFHKYFDYRKEEIRTRIRIAIEFIKKSQLPDGSWYGSWGICFTYAGMFALEALHTVGETYENSSTVRKGCDFLVSKQMKDGGWGESMKSSELHSYVDSEKSLVVQTAWALIALLFAEYPNKEVIDRGIDLLKNRQEESGEWKFESVEGVFNHSCAIEYPSYRFLFPIKALGMYSRAYETHTL

SEQ ID NO: 112 - DNA, 2106 bp, Artificial Sequence
  DNA sequence encoding S. grosvenorii CPR4497
atgaaggtctctccatttgagttcatgtcggcaataattaagggcaggatggacccgtccaattcttcatttgagtcgactggcgaggttgcctcagttattttcgagaaccgtgagctggttgcgatcttaaccacctcgatcgccgtcatgattggctgcttcgttgttctcatgtggcgaagagccggcagtcggaaagttaagaacgtggagctacctaagccgttgattgtgcacgagccggagcccgaagttgaagacggcaagaagaaggtttcaatcttcttcggtacacagacaggcaccgccgaaggatttgcaaaggctctagctgacgaggcgaaagcacgatacgagaaggccacatttagagttgttgatttggatgattatgcagctgatgacgatcagtatgaagagaagttgaagaacgagtctttcgctgtcttcttattggcaacgtatggcgatggagagcccactgataatgccgcaagattctataaatggttcgcggaggggaaagagagaggggagtggcttcagaaccttcattatgcggtctttggccttggcaaccgacagtacgagcattttaataagattgcaaaggtggcagatgagctgcttgaggcacagggaggcaaccgccttgttaaagttggtcttggagatgacgatcagtgcatagaggatgacttcagtgcctggagagaatcattgtggcctgagttggatatgttgcttcgagatgaggatgatgcaacaacagtgaccaccccttacacagctgccgtattagaatatcgagttgtattccatgattctgcagatgtagctgctgaggacaagagctggatcaatgcaaacggtcatgctgtacatgatgctcagcatcccttcagatctaatgtggttgtgaggaaggagctccatacgtccgcatctgatcgctcctgtagtcatctagaatttaatatttctgggtctgcactcaattatgaaacaggggatcatgtcggtgtttactgtgaaaacttaactgagactgtggacgaggcactaaacttattgggtttgtctcctgaaacgtatttctccatatatactgataacgaggatggcactccacttggtggaagctctttaccacctccttttccatcctgcaccctcagaacagcattgactcgatatgcagatctcttgaattcacccaagaagtcagctttgcttgcattagcagcacatgcttcaaatccagtagaggctgaccgattaagatatcttgcatcacctgccgggaaggatgaatacgcccagtctgtgattggtagccagaaaagccttcttgaggtcatggctgaatttccttctgccaagcccccacttggtgtcttcttcgcagctgttgcaccgcgcttgcagcctcgattctactccatatcatcatctccaaggatggctccatctagaattcatgttacttgtgctttagtctatgacaaaatgccaacaggacgtattcataaaggagtgtgctcaacttggatgaagaattctgtgcccatggagaaaagccatgaatgcagttgggctccaattttcgtgagacaatcaaacttcaagcttcctgcagagagtaaagtgcccattatcatggttggtcctggaactggattggctcctttcagaggtttcttacaggaaagattagctttgaaggaatctggagtagaattggggccttccatattgttctttggatgcagaaaccgtaggatggattacatatacgaggatgagctgaacaactttgttgagactggtgctctctctgagttggttattgccttctcacgcgaagggccaactaaggaatatgtgcagcataaaatggcagagaaggcttcggatatctggaatttgatatcagaaggggcttacttatatgtatgtggtgatgcaaagggcatggctaaggatgtccaccgaactctccatactatcatgcaagagcagggatctcttgacagctcaaaagctgagagcatggtgaagaatctgcaaatgaatggaaggtatctgcgtgatgtctggtga

SEQ ID NO: 113 - protein, 701 aa, Artificial Sequence
  Amino acid sequence of S. grosvenorii CPR4497
MKVSPFEFMSAIIKGRMDPSNSSFESTGEVASVIFENRELVAILTTSIAVMIGCFVVLMWRRAGSRKVKNVELPKPLIVHEPEPEVEDGKKKVSIFFGTQTGTAEGFAKALADEAKARYEKATFRVVDLDDYAADDDQYEEKLKNESFAVFLLATYGDGEPTDNAARFYKWFAEGKERGEWLQNLHYAVFGLGNRQYEHFNKIAKVADELLEAQGGNRLVKVGLGDDDQCIEDDFSAWRESLWPELDMLLRDEDDATTVTTPYTAAVLEYRVVFHDSADVAAEDKSWINANGHAVHDAQHPFRSNVVVRKELHTSASDRSCSHLEFNISGSALNYETGDHVGVYCENLTETVDEALNLLGLSPETYFSIYTDNEDGTPLGGSSLPPPFPSCTLRTALTRYADLLNSPKKSALLALAAHASNPVEADRLRYLASPAGKDEYAQSVIGSQKSLLEVMAEFPSAKPPLGVFFAAVAPRLQPRFYSISSSPRMAPSRIHVTCALVYDKMPTGRIHKGVCSTWMKNSVPMEKSHECSWAPIFVRQSNFKLPAESKVPIIMVGPGTGLAPFRGFLQERLALKESGVELGPSILFFGCRNRRMDYIYEDELNNFVETGALSELVIAFSREGPTKEYVQHKMAEKASDIWNLISEGAYLYVCGDAKGMAKDVHRTLHTIMQEQGSLDSSKAESMVKNLQMNGRYLRDVW

SEQ ID NO: 114 - DNA, 954 bp, Artificial Sequence
  Codon optimized nucleotide sequence of Epoxide hydrolase 1 of S grosvenorii
atggacgcgattgaacatagaaccgtaagtgttaatggtatcaatatgcatgtggcagaaaagggagagggacctgtcgtgttgttgcttcatggtttcccagaattgtggtacagttggagacatcaaatattggctctttcctctttaggttacagagctgtcgcaccagacttacgaggctacggggatacagatgccccagggtcaatttcatcatacacatgctttcacatcgtaggagatctcgtggctctagttgagtctctgggtatggacagggtttttgttgtagcccacgattggggtgccatgatcgcttggtgtttgtgtctgtttagacctgaaatggttaaagcttttgtttgtctctccgtcccattcagacagagaaaccctaagatgaaaccagttcaaagtatgagagcctttttcggcgatgattactatatttgcagatttcaaaatcctggggaaatcgaagaggagatggctcaagtgggtgcaagggaagtcttaagaggaattctaacatctcgtcgtcctggaccaccaatcttaccaaaagggcaagcttttagagcaagaccaggagcatccactgcattgccatcttggctatctgaaaaagatctgtcatttttcgcttctaagtatgatcaaaagggctttacaggcccactaaactactacagagccatggatcttaattgggaattgactgcgtcatggactggtgtccaagttaaagtacctgtcaaatacatcgtgggtgacgttgacatggtttttacgactcctggtgtaaaggaatatgtcaacggcggtggtttcaaaaaggacgttccatttttacaggaagtggtaatcatggaaggcgttggtcatttcattaatcaggaaaaacctgaggagatttcatctcatatacacgatttcataagcaaattctaa

SEQ ID NO: 115 - DNA, 951 bp, Artificial Sequence
  Codon optimized nucleotide sequence of Epoxide hydrolase 2 of S grosvenorii
atggatgaaatcgaacatattaccatcaatacaaatggaatcaaaatgcatattgcgtcagtcggcacaggaccagttgttctcttgctacacggctttccagaattatggtactcttggagacaccaactactttacctgtcctccgttgggtacagagcaatagctccagatttgagaggctatggcgatactgacagtccagctagtcctacctcttatactgctcttcatattgtaggtgacctggtcggcgcattagacgaattgggaatagaaaaggtctttttagtgggtcatgactggggtgctattatcgcatggtacttttgtttgtttagaccagatagaattaaagcacttgtgaatttgtctgtccagtttatcccacgtaacccagcaataccttttatagaaggtttcagaacagcttttggtgatgacttctacatttgtagatttcaagtacctggggaagctgaagaggatttcgcgtctatcgatactgctcaattgtttaaaacttcattatgcaatagaagctcagcccctccttgtttgcctaaagagattggttttagggctatcccaccaccagaaaatctgccatcttggctcacagaggaagatatcaacttctacgcagccaagtttaaacaaactggttttactggtgcccttaactattatagagcattcgacttgacatgggaattaacagccccatggacaggagcccagatccaagttcctgtaaagttcatagttggtgattcagatctcacgtaccatttccctggtgctaaggaatacatccacaacggagggtttaaaagagatgtgccactattagaggaagttgttgtggtaaaagatgcctgccacttcattaaccaagagcgaccacaagagattaatgctcatattcatgacttcatcaataagttctaa

SEQ ID NO: 116 - DNA, 174 bp, Artificial Sequence
  S grosvenorii UGT3494
atggcggatcggaaagagagcgttgtgatgttcccgttcatggggcagggccatatcatcccttttctagctttggccctccagattgagcacagaaacagaaactacgccatatacttggtaaatactcctctcaacgttaagaaaatgagatcttctctccctccagattga

SEQ ID NO: 117 - DNA, 1242 bp, Artificial Sequence
  Fragment of S grosvenorii UGT11789
ttctgctccacgcctgtaaatttggaagccattaaaccaaagctttccaaaagctactctgattcgatccaactaatggaggttcctctcgaatcgacgccggagcttcctcctcactatcatacagccaaaggccttccgccgcatttaatgcccaaactcatgaatgcctttaaaatggttgctcccaatctcgaatcgatcctaaaaaccctaaacccagatctgctcatcgtcgacattctccttccatggatgcttccactcgcttcatcgctcaaaattccgatggttttcttcactattttcggtgccatggccatctcctttatgatttataatcgaaccgtctcgaacgagcttccatttccagaatttgaacttcacgagtgctggaaatcgaagtgcccctatttgttcaaggaccaagcggaaagtcaatcgttcttagaatacttggatcaatcttcaggcgtaattttgatcaaaacttccagagagattgaggctaagtatgtagactttctcacttcgtcgtttacgaagaaggttgtgaccaccggtcccctggttcagcaaccttcttccggcgaagacgagaagcagtactccgatatcatcgaatggctagacaagaaggagccgttatcgacggtgctcgtttcgtttgggagcgagtattatctgtcaaaggaagagatggaagaaatcgcctacgggctggagagcgccagcgaggtgaatttcatctggattgttaggtttccgatgggacaggaaacggaggtcgaggcggcgctgccggaggggttcatccagagggcaggagagagagggaaagtggtcgagggctgggctccgcaggcgaaaatattggcgcatccgagcaccggcggccatgtgagccacaacgggtggagctcgattgtggagtgcttgatgtccggtgtaccggtgatcggcgcgccgatgcaacttgacgggccaatcgtcgcaaggctggtggaggagatcggcgtgggtttggaaatcaagagagatgaggaagggagaatcacgaggggcgaagttgccgatgcaatcaagacggtggcggtgggcaaaaccggggaagattttagaaggaaagcaaaaaaaatcagcagcattttgaagatgaaagatgaagaagaggttgacactttggcaatggaattagtgaggttatgccaaatgaaaagagggcaggagtctcaggactaa

SEQ ID NO: 118 - DNA, 912 bp, Artificial Sequence
  S. grosvenorii UGT11999
tcccggtcaacggtagaggacttcacggagcttcgagagtggatgccttctggatcgaacatggtctaccggtaccacgagattaaaaaatccttagatggagcaaccggcaacgaatcggggacgtctgattcggtccgattcggaattgtgattgaggagagtgttgctgtggctgtaagaagctcccctgaactggaaccggaatggttcgatttgctcgcgaagctttaccagaagccagttgttccggtaggatttctacctccagtaattgaagatgcggaagaattgagcagcgatatcaaggaatggttagacaaacagagctcaaactcggtcctttacgtcgcattcgggaccgaggcgactctgagtcaagatgacgtcactgagttagccatggggcttgagcaatctgggataccatttttctgggtactgagaacctcacctcgggacgagtcagacatgttaccggccgggttcaaggagcgagtcgaaggtcgaggaagtgttcacgtgggatgggtctcgcaggtgaagatactgagtcacgactcggttggcggttgtttgacacactgtggatggaactcgatcatagaggggctcggattcgggcgcgttatggtattgtttccagtcgtgaacgaccagggattgaacgctagattgttgggggagaagaagctcgggatagagatagaaagggacgagcgagatggatcgttcacacgcgactcggtgtcggaatcggtgaggtcggcaatggcggaaagttcaggcgaggccttgagagtgagggccagggaaatgaaggggttgtttggaaacggagatgagaacgagcatcaactgaacaagtttgtacaatttctcgaggcaaacaggaataggcagtccgagtaa

SEQ ID NO: 119 - DNA, 1125 bp, Artificial Sequence
  Partial sequence from Siraitia grosvenorii UGT13679
ctgctgccgattccgctgccgaaaccggccgccgatctcttgccggaaggtgcagaggcgacggtggatattccgtccgacaagattccgtatctgaaattggccctcgatctcgccgagcagccgtttcggaagttcgtcgttgatcgtccgccggattggatgatcgtcgattttaatgctacttgggtctgcgatatttctcgggagcttcaaatcccaatcgttttctttcgtgttctttcgcctggatttcttgctttctttgcgcatgttcttgggagtggtctgccgctgtcggagatcgaaagcctgatgactccgccggtgatcgacgggtcgacggtggcgtaccgccggcatgaagctgccgttatttgtgctgggttttttgagaagaacgcttctggtatgagtgatcgcgatcgggtaaccaaaattctctctgccagtcaagcaatcgcagttcgttcttgctacgaatttgacgttgagtatttgaaattgtacgagaaatattgtggaaaaagagtgattcctctagggtttctccctccagaaaagccccaaaagtccgagttcgccgccgattcgccatggaaaccgaccttcgagtggcttgacaaacaaaagccccgatcagtggtgttcgtcggattcggcagcgaatgcaaactcacgaaagatgatgtttacgagatagcgcgcggggtggagctgtcggagctgccatttttgtgggctctgagaaaaccgatctgggcggcggcggacgattccgacgctctgcctgccggattcctcgagcggacggcggagagagggattgtgagcatggggtgggcgccgcagatggagattttaacgcacccgtcgattggcggctctctgtttcacgccgggtggggatccgccattgaagctctgcaattcgggcattgccttgttctgttgccattcatcgtggatcagccactgaatgcaaggcttctggtggagaagggtgttgcagtcgaagttggaagaaaggaagacgggtcttttagtggagaagacatagctaaagctctgagagaagctatggtttcagaagaaggtgagcagatgaggaggcaagcgagaaag

SEQ ID NO: 120 - DNA, 486 bp, Artificial Sequence
  Partial sequence of S grosvenorii UGT 15423
atggaaaacgacggcgttttgcacgtggtggtattcccatggctagccttgggtcatctcattcctttcgctcgactcgccacctgcttagcccacaagggtctcagggtttcgttcgtatcaaccacaaggaacctgagcagaattcccaaaatacccccacatctctcctcctccgtcaacctcgtcggctttcctctgccccacgtcgacggccttccggacgccgccgaggcttcctccgacgtgccttacaacaagcaacagttactgaagaaggccttcgactctctggaatcaccgctcgccgatttgcttcgtgatttgaatcccgattggattatctacgattacgcctctcattggcttccgcagctcgcggcggagctccgtatctcgtctgttttcttcagcctcttcaccgcggcgtttcttgcttttcttggcccaccgtcggcgttgtccggcgacggcagttcccggtga

SEQ ID NO: 121 - DNA, 1491 bp, Artificial Sequence
  Nucleotide sequence encoding S grosvenorii UGT1576
atggcttctcctcgccacactcctcactttctgctcttccctttcatggctcaaggccacatgatccccatgattgaccttgccaggcttctggctcagcgaggagttatcatcactattatcaccacgccccacaatgctgctcgctaccactctgttcttgctcgcgccatcgattctgggttacacatccatgtcctccaactgcagtttccatgtaaggaaggtgggctgccagaagggtgcgagaatgtggacttgctaccttcacttgcttccatacccagattctacagagcagcaagtgatctcctttacgaaccatctgaaaaactgtttgaggaactcatcccccggccgacctgcataatctccgatatgtgcctgccctggaccatgcgaattgctctgaaatatcacgtcccaaggctcgttttctacagtttgagctgcttctttcttctctgtatgcggagtttaaaaaacaatctagcgcttataagctccaagtctgattctgagttcgtaactttctctgacttgcctgatccagtcgagtttctcaagtcggagctacctaaatccaccgatgaagacttggtgaagtttagttatgaaatgggggaggccgatcggcagtcatacggcgttattttaaatctatttgaggagatggaaccaaagtatcttgcagaatatgaaaaggaaagagaatcgccggaaagagtctggtgcgtcggcccagtttcgctttgcaacgacaacaaactcgacaaagctgaaagaggcaacaaagcctccatcgacgaatacaaatgcatcaggtggctcgacgggcagcagccatcttcggtggtttacgtctctttaggaagcttgtgcaatctggtgacggcgcagatcatagagctgggtttgggtttggaggcatcaaagaaacccttcatttgggtcataagaagaggaaacataacagaggagttacagaaatggcttgtggagtacgatttcgaggagaaaattaaagggagagggctggtgattcttggctgggctccccaagttctgatactgtcacaccctgcaatcggatgctttttgacgcactgcggttggaactcaagcatcgaagggatatcggccggcgtgccaatggtcacctggccgctttttgcggatcaagtcttcaacgagaagctaattgtacaaatactcagaatcggcgtaagtgtaggcacggaaactactatgaactggggagaggaagaggagaaaggggtggttgtgaagagagagaaagtgagggaagccatagaaatagtgatggatggagatgagagagaagagaggagagagagatgcaaagagcttgctgaaacggcgaagagagctatagaagaagggggctcgtctcaccggaacctcacgatgttgattgaagatataattcatggaggaggtttgagttatgagaaaggaagttgtcgctga

SEQ ID NO: 122 - DNA, 1380 bp, Artificial Sequence
  Nucleotide sequence encoding S grosvenorii UGT SK98
atggatgcccagcgaggtcacaccaccaccattttgatgcttccatgggtcggctacggccatctcttgcctttcctcgagctggccaaaagcctctccaggaggaaattattccacatctacttctgttcaacgtctgttagcctcgacgccattaaaccaaagcttcctccttctatctcttctgatgattccatccaacttgtggaacttcgtctcccttcttctcctgagttacctcctcatcttcacacaaccaacggccttccctctcacctcatgcccgctctccaccaagccttcgtcatggccgcccaacactttcaggtcattttacaaacacttgccccgcatctcctcatttatgacattctccaaccttgggctcctcaagtggcttcatccctcaacattccagccatcaacttcagtactaccggagcttcaatgctttctcgaacgcttcaccctactcactacccaagttctaaattcccaatctcagagtttgttcttcacaatcactggagagccatgtacaccaccgccgatggggctcttacagaagaaggccacaaaattgaagaaacacttgcgaattgcttgcatacttcttgcggggtagttttggtcaatagtttcagagagcttgagacgaaatatatcgattatctctctgttctcttgaacaagaaagttgttccggtcggtcctttggtttacgaaccgaatcaagaaggggaagatgaaggttattcaagcatcaaaaattggcttgacaaaaaggaaccgtcctcaaccgtcttcgtttcatttggaaccgaatacttcccgtcaaaggaagaaatggaagagatagcgtatgggttagagctgagcgaggttaatttcatctgggtccttagatttcctcaaggagacagcaccagcaccattgaagacgccttgccgaaggggtttctggagagagcgggagagagggcgatggtggtgaagggttgggctcctcaggcgaagatactgaagcattggagcacaggggggcttgtgagtcactgtggatggaactcgatgatggagggcatgatgtttggcgtacccataatagcggtcccgatgcatctggaccagccctttaacgccggactcttggaagaagctggcgtcggcgtggaagccaagcgaggttcggacggcaaaattcaaagagaagaagttgcaaagtcgatcaaagaagtggtgattgagaaaaccagggaagacgtgaggaagaaagcaagagaaatgggtgagattttgaggagtaaaggagatgagaaaattgatgagttggtggctgaaatttctcttttgcgcaaaaaggctccatgttcaatttaa

SEQ ID NO: 123 - DNA, 1377 bp, Artificial Sequence
  Nucleotide sequence encoding S grosvenorii UG98
atggatgcccagcgaggtcacaccacaaccattttgatgtttccatggctcggctatggccatctttcggctttcctagagttggccaaaagcctctcaaggaggaacttccatatctacttctgttcaacctctgttaacctcgacgccattaaaccaaagcttccttcttcttcctcttctgattccatccaacttgtggaactttgtcttccatcttctcctgatcagctccctcctcatcttcacacaaccaacgccctcccccctcacctcatgcccactctccaccaagccttctccatggctgcccaacactttgctgccattttacacacacttgctccgcatctcctcatttacgactctttccaaccttgggctcctcaactagcttcatccctcaacattccagccatcaacttcaatactacgggagcttcagtcctgacccgaatgcttcacgctactcactacccaagttctaaattcccaatttcagagtttgttctccacgattattggaaagccatgtacagcgccgccggtggggctgttacaaaaaaagaccacaaaattggagaaacacttgcgaattgcttgcatgcttcttgtagtgtaattctaatcaatagtttcagagagctcgaggagaaatatatggattatctctccgttctcttgaacaagaaagttgttccggttggtcctttggtttacgaaccgaatcaagacggggaagatgaaggttattcaagcatcaaaaattggcttgacaaaaaggaaccgtcctccaccgtcttcgtttcatttggaagcgaatacttcccgtcaaaggaagaaatggaagagatagcccatgggttagaggcgagcgaggttcatttcatctgggtcgttaggtttcctcaaggagacaacaccagcgccattgaagatgccttgccgaaggggtttctggagagggtgggagagagagggatggtggtgaagggttgggctcctcaggcgaagatactgaagcattggagcacagggggattcgtgagccactgtggatggaactcggtgatggaaagcatgatgtttggcgttcccataataggggttccgatgcatctggaccagccctttaacgccggactcgcggaagaagctggcgtcggcgtggaagccaagcgagattcggacggcaaaattcaaagagaagaagttgcaaagtcgatcaaagaagtggtgattgagaaaaccagggaagacgtgaggaagaaagcaagagaaatgggtgagattttgaggagtaaaggagatgagaaaattgatgagttggtggctgaaatttctcttttgcgcaaaaaggctccatgttcaatttaa

SEQ ID NO: 124 - DNA, 419 bp, Artificial Sequence
  Nucleotide sequence encoding codon optimized UGT SK98
catttgtctgcttttttggaattggccaagtccttgtctagaagaaacttccatatctacttttgctccacctccgttaatttggatgctattaagccaaagttgccatcctcttcatcctccgattctattcaattggttgaattgtgcttgccatcttccccagatcaattgccaccacacttgcatacaactaatgctttaccaccacatttgatgccaacattgcatcaagctttttctatggctgctcaacattttgctgctatcttgcatacttggctcctcatttgttgatctacgattcttttcaaccatgggctccacaattggcttcatctttgaatattccagccatcaacttcaacactactggtgcttcagttttgaccagaatgttgcatgctactcattaccca

SEQ ID NO: 125 - protein, 453 aa, Artificial Sequence
  UGT polypeptide is also referred to as UGT94A9, A9 or UGT94-289-1
MDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFNTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKI

SEQ ID NO: 126 - protein, 316 aa, Artificial Sequence; identical to SEQ ID NO: 24
  UGT polypeptide is also referred to as EH1, EPH1 and contig 73966

SEQ ID NO: 127 - DNA, 1425 bp, Artificial Sequence
  Gene encoding UGT UCT85E5
atggtgcaacctcgggtactgctgtttcctttcccggcactgggccacgtgaagcccttcttatcactggcggagctgctttccgacgccggcatagacgtcgtcttcctcagcaccgagtataaccaccgtcggatctccaacactgaagccctagcctcccgcttcccgacgcttcatttcgaaactataccggatggcctgccgcctaatgagtcgcgcgctcttgccgacggcccactgtatttctccatgcgtgagggaactaaaccgagattccggcaactgattcaatctcttaacgacggtcgttggcccatcacctgtattatcactgacatcatgttatcttctccgattgaagtagcggaagaatttgggattccagtaattgccttctgcccctgcagtgctcgctacttatcgattcacttttttataccgaagctcgttgaggaaggtcaaattccatacgcagatgacgatccgattggagagatccagggggtgcccttgttcgaaggtcttttgcgacggaatcatttgcctggttcttggtctgataaatctgcagatatatctttctcgcatggcttgattaatcagacccttgcagctggtcgagcctcggctcttatactcaacaccttcgacgagctcgaagctccatttctgacccatctctcttccattttcaacaaaatctacaccattggacccctccatgctctgtccaaatcaaggctcggcgactcctcctcctccgcttctgccctctccggattctggaaagaggatagagcctgcatgtcctggctcgactgtcagccgccgagatctgtggttttcgtcagtttcgggagtacgatgaagatgaaagccgatgaattgagagagttctggtatgggttggtgagcagcgggaaaccgttcctctgcgtgttgagatccgacgttgtttccggcggagaagcggcggaattgatcgaacagatggcggaggaggagggagctggagggaagctgggaatggtagtggagtgggcagcgcaagagaaggtcctgagccaccctgccgtcggtgggtttttgacgcactgcgggtggaactcaacggtggaaagcattgccgcgggagttccgatgatgtgctggccgattctcggcgaccaacccagcaacgccacttggatcgacagagtgtggaaaattggggttgaaaggaacaatcgtgaatgggacaggttgacggtggagaagatggtgagagcattgatggaaggccaaaagagagtggagattcagagatcaatggagaagctttcaaagttggcaaatgagaaggttgtcaggggtgggttgtcttttgataacttggaagttctcgttgaagacatcaaaaaattgaaaccatataaattttaa

SEQ ID NO: 128 - protein, 419 aa, Artificial Sequence
  UGT protein
MVQPRVLLFPFPALGHVKPFLSLAELLSDAGIDVVFLSTEYNHRRISNTEALASRFPTLHFETIPDGLPPNESRALADGPLYFSMREGTKPRFRQLIQSLNDGRWPITCIITDIMLSSPIEVAEEFGIPVIAFCPCSARYLSIHFFIPKLVEEGQIPYADDDPIGEIQGVPLFEGLLRRNHLPGSWSDKSADISFSHGLINQTLAAGRASALILNTFDELEAPFLTHLSSIFNKIYTIGPLHALSKSRLGDSSSSASALSGFWKEDRACMSWLDCQPPRSVVFVSFGSTMKMKADELREFWYGLVSSGKPFLCVLRSDVVSGGEAAELIEQMAEEEGAGGKLGMVVEWAAQEKVLSHPAVGGFLTHCGWNSTVESIAAGVPMMCWPILGDQPSNATWIDRVWKIGVERNNREWDRLTVE

SEQ ID NO: 129 - protein, 452 aa, Artificial Sequence
  UGT polypeptide referred to as UGT94C9 and UGT94-289-3
MDAAQQGDTTTILMLPWLGYGHLSAFLELAKSLSRRNFHIYFCSTSVNLDAIKPKLPSSFSDSIQFVELHLPSSPEFPPHLHTTNGLPPTLMPALHQAFSMAAQHFESILQTLAPHLLIYDSLQPWAPRVASSLKIPAINFNTTGVFVISQGLHPIHYPHSKFPFSEFVLHNHWKAMYSTADGASTERTRKRGEAFLYCLHASCSVILINSFRELEGKYMDYLSVLLNKKVVPVGPLVYEPNQDGEDEGYSSIKNWLDKKEPSSTVFVSFGSEYFPSKEEMEEIAHGLEASEVNFIWVVRFPQGDNTSGIEDALPKGFLERAGERGMVVKGWAPQAKILKHWSTGGFVSHCGWNSVMESMMFGVPIIGVPMHVDQPFNAGLVEEAGVGVEAKRDPDGKIQRDEVAKLIKEVVVEKTREDVRKKAREMSEILRSKGEEKFDEMVAEISLLLKI

SEQ ID NO: 130 - DNA, 3998 bp, Artificial Sequence
  Genes for encoding enzymes for acetyl CoA synthesis
tcacaacgtttagctttgacagatggtatcgccgtgacagacggggtcaaagaagtttggctttcataaaaagagctagacattcaagcaaaaacttgaatgtctagctcttttgttgattgaatcgggggatttaaatacttagtttcgataagagcgaacggtattattaatagcagaaatactatattttaattcatcttctaacgtttgatcaatatctgtgtctaaagtttctgcaaacatggcttcatattcagcgatagaaagttctgtccgattatctagcagtgctaaatgagtttctttttgtaaatgattttgataaccagctactaattcaccagtgaaaaattcagcgacagcaccagaaccataactgaataacccaatttgattgcctgcggttaaagtcgttgcattttctaaaagggaaatgagtcccagataaagtgaacccgtatacaagtttcctacgcgacgactatagatgatgctttcttcataacgggctaaaattcgttcctgttctgcttcagtttggtcggagatttttgctaataaggcttttttgcccatttttgtgtaaggaatatggaacgctaaagcatcataatctgcaaaatcaagaccggttctttttttatgttcatcccagacttgggcaaaagattggatgtaggtttcgtttgacaaaggaccatcgaccataggatacggatggcctgttggacgccaaaagtcatagatatcttgcgtcagcatcacattatcctcttttaaagccaagatgcgcggttcactagcaactaacattgcaaccgccccagctccttgtgtaggctcaccgccagaatttaatccatattttgcaatatctgctgctacaaccaagacttttttatctggatgtaaggctacgtgattcttagctaactgtaagcctgctgttgctccgtaacaagcttccttgatttcgaaagagcgagcgaaaggttgaatccccattaaacgatgtaagacaactgcggccgcttttgactcatcgatactggactcagtcccgacaatcaccatatcaatggcctctttatcttctttggtcaagatcgcttctgcggcattggctgcaaatgtcacaatatcttggctgattgggttcaccgccatttggtcttgcccaataccaatatgaaattttccagggtctacatttctggcttcagccagtgccgtcatatcaatataataagggggcacaaaaaaactaattttatcaatcccaattgtcatttctttaactcctttacgataaatagattcattatataaaatagcacgaaatgaaccaaaatggggaatttttgtattaacttcatagattattaaaaaatatcttataagtctgttaacattcagtaattggcacttgtgattctgggattttatgatatatttcaagatggaggtgcatttagttgaaaacagtagttattattgatgcattacgaacaccaattggaaaatataaaggcagcttaagtcaagtaagtgccgtagacttaggaacacatgttacaacacaacttttaaaaagacattccactatttctgaagaaattgatcaagtaatctttggaaatgttttacaagctggaaatggccaaaatcccgcacgacaaatagcaataaacagcggtttatctcatgaaattcccgcaatgacagttaatgaggtctgcggatcaggaatgaaggccgttattttggcgaaacaattgattcaattaggagaagcggaagttttaattgctggcgggattgagaatatgtcccaagcacctaaattacaacgatttaattacgaaacagaaagctatgatgcgcctttttctagtatgatgtacgatgggttaacggatgcctttagtggtcaagcaatgggcttaactgctgaaaatgtggccgaaaagtatcatgtaactagagaagagcaagatcaattttctgtacattcacaattaaaagcagctcaagcacaagcagaagggatattcgctgacgaaatagccccattagaagtatcaggaacgcttgtggagaaagatgaagggattcgccctaattcgagcgttgagaagctaggaacgcttaaaacagtttttaaagaagacggtactgtaacagcagggaatgcatcaaccattaatgatggggcttctgctttgattattgcttcacaagaatatgccgaagcacacggtcttccttatttagctattattcgagacagtgtggaagtcggtattgatccagcctatatgggaatttcgccgattaaagccattcaaaaactgttagcgcgcaatcaacttactacggaagaaattgatctgtatgaaatcaacgaagcatttgcagcaacttcaatcgtggtccaaagagaactggctttaccagaggaaaaggtcaacatttatggtggcggtatttcattaggtcatgcgattggtgccacaggtgctcgtttattaacgagtttaagttatcaattaaatcaaaaagaaaagaaatatggagtggcttctttatgtatcggcggtggcttaggactcgctatgctactagagagacctcagcaaaaaaaaaacagccgatttatcaaatgagtcctgaggaacgcctggcttctcttcttaatgaaggccagatttctgctgatacaaaaaaagaatttgaaaatacggctttatcttcgcagattgccaatcatatgattgaaaatcaaatcagtgaaacagaagtgccgatgggcgttggcttacatttaacagtggacgaaactgattatttggtaccaatggcgacagaagagccctcagtgattgcggctttgagtaatggtgcaaaaatagcacaaggatttaaaacagtgaatcaacaacgtttaatgcgtggacaaatcgttttttacgatgttgcagacgccgagtcattgattgatgaactacaagtaagagaaacggaaatttttcaacaagcagagttaagttatccatctatcgttaaacgcggcggcggcttaagagatttgcaatatcgtgcttttgatgaatcatttgtatctgtcgactttttagtagatgttaaggatgcaatgggggcaaatatcgttaacgctatgttggaaggtgtggccgagttgttccgtgaatggtttgcggagcaaaagattttattcagtattttaagtaattatgccacggagtcggttgttacgatgaaaacggctattccagtttcacgtttaagtaaggggagcaatggccgggaaattgctgaaaaaattgttttagcttcacgctatgcttcattagatccttatcgggcagtcacgcataacaaagggatcatgaatggcattgaagctgtcgttttagctacaggaaatgatacacgcgctgttagcgcttcttgtcatgcttttgcggtgaaggaaggtcgctaccaaggtttgactagttggacgctggatggcgaacaactaattggtgaaatttcagttccgcttgcgttagccacggttggcggtgccacaaaagtcttacctaaatctcaagcagctgctgatttgttagcagtgacggatgcaaaagaactaagtcgagtagtagcggctgttggtttggcacaaaatttagcggcgttacgggccttagtctctgaaggaattcaaaaaggacacatggctctacaagcacgttctttagcgatgacggtcggagctactggtaaagaagttgaggcagtcgctcaacaattaaaacgtcaaaaaacgatgaaccaagaccgagccttggctattttaaatgatttaagaaaacaataaaaaaacagttcagcagaaattattctgctgaactgttttttttcacattaggtagccgtttcaggccacgaattggttttacttttaagacatctaagaagaaagtgaa

SEQ ID NO: 131-147 - skipped (17 entries)

SEQ ID NO: 148 - protein, 711 aa, Artificial Sequence; identical to SEQ ID NO: 3
  CGT-SL glucotransferases

SEQ ID NO: 149-153 - skipped (5 entries)

SEQ ID NO: 154 - protein, 364 aa, Artificial Sequence; identical to SEQ ID NO: 100
  CGT-SL glucotransferases

SEQ ID NO: 155 - skipped

SEQ ID NO: 156 - protein, 1375 aa, Artificial Sequence
  DexT protein [Leuconostoc citreum]
MPANAPDKQSVTNAPVVPPKHDTDQQDDSLEKQQVLEPSVNSNIPKKQTNQQLAVVTAPANSAPQTKTTAEISAGTELDTMPNVKHVDGKVYFYGDDGQPKKNFTTIIDGKPYYFDKDTGALSNNDKQYVSELFSIGNKHNAVYNTSSDNFTQLEGHLTASSWYRPKDILKNGKRWAPSTVTDFRPLLMAWWPDKSTQVTYLNYMKDQGLLSGTHHFSDNENMRTLTAAAMQAQVNIEKKIGQLGNTDWLKTAMTQYIDAQPNWNIDSEAKGDDHLQGGALLYTNSDMSPKANSDYRKLSRTPKNQKGQIADKYKQGGFELLLANDVDNSNPVVQAEQLNWLHYMMNIGSILQNDDQANFDGYRVDAVDNVDADLLQIAGEYAKAAYGVDKNDARANQHLSILEDWGDEDPDYVKAHGNQQITMDFPLHLAIKYALNMPNDKRSGLEPTREHSLVKRITDDKENVAQPNYSFIRAHDSEVQTIIADIIKDKINPASTGLDSTVTLDQIKQAFDIYNADELKADKVYTPYNIPASYALLLTNKDTIPRVYYGDMFTDDGQYMAKQSPYYQAIDALLKARIKYAAGGQTMKMNYFPDEQSVMTSVRYGKGAMTASDSGNQETRYQGIGLVVNNRPDLKLSDKDEVKMDMGAAHKNQDYRPVLLTTKSGLKVYSTDANAPVVRTDANGQLTFKADMVYGVNDPQVSGYIAAWVPVGASENQDARTKSETTQSTDGSVYHSNAALDSQVIYEGFSNFQDFPTTPDEFTNIKIAQNVNLFKDWGITSFEMAPQYRASSDKSFLDAIVQNGYAFTDRYDIGYNTPTKYGTADNLLDALRALHGQGIQAINDWVPDQIYNLPDEQLVTAIRTDGSGDHTYGSVIDHTLYASKTVGGGIYQQQYGGAFLEQLKTQYPQLFQQKQISTDQPMNPDIQIKSWEAKYFNGSNIQGRGAWYVLKDWGTQQYFNVSDAQTFLPKQLLGEKAKTGFVTRGKETSFYSTSGYQAKSAFICDNGNWYYFDDKGKMVVGNQVINGINYYFLPNGIELQDAYLVHDGMYYYYNNIGKQLHNTYYQDKQKNFHYFFEDGHMAQGIVTIIQSDGTPVTQYFDENGKQQKGVAVKGSDGHLHYFDGASGNMLFKSWGRLADGSWLYVDEKGNAVTGKQTINNQTVYFNDDGRQIKNNFKELADGSWLYLNNKGVAVTGEQIINGQTLYFGNDGRQFKGTTHINATGESRYYDPDSGNMITDRFERVGDNQWAYFGYDGVAVTGDRIIKGQKLYFNQNGIQMKGHLRLENGIMRYYDADTGELVRNRFVLLSDGSWVYFGQDGVPVTGVQVINGQTLYFDADGRQVKGQQRVIGNQRYWMDKDNGEMKKITYAAALE

SEQ ID NO: 157 - DNA, 4146 bp, Artificial Sequence; identical to SEQ ID NO: 104
  DexT

SEQ ID NO: 158 - DNA, 4530 bp, Artificial Sequence; identical to SEQ ID NO: 105
  DexT

SEQ ID NO: 159-162 - skipped (4 entries)

SEQ ID NO: 163 - protein, 660 aa, Artificial Sequence
  Transgucosidase CAA25303.1 GI:2343
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWREYTVPQACGTSTATVTDTWR

SEQ ID NO: 164 - protein, 614 aa, Artificial Sequence
  Glucoamylase G1 1008149A
ATLDSWLSNEATVARTAILNNIGADGAWVSGADSGIVVASPSTDNPTYFYTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 165 - protein, 227 aa, Artificial Sequence
  Transgucosidase
  VARIANT 11, 99, 118, 193: Xaa = Any Amino Acid
SLLAPSQPQFXIPASAAVGAQLIANIDDPQAADAQSVCPGYKASKVQHNSRGFTASLQLAGRPCNVYGTDVESLTLSVEYQDSDRLNIQILPTHVDSTXASWYFLSENLVPRPKASLXASVSQSDLFVSWSNEPSFNFKVIRKATGDALFSTEGTVLVYENQFIEFVTALPEEYNLYGLGEHITQFRLQRNAXLTIYPSDDGTPIDQNLYGQHPFYLDTRYYKGDRQ

SEQ ID NO: 166 - protein, 719 aa, Artificial Sequence
  Transgucosidase AAB23581.1
  VARIANT 81, 156, 240, 268, 271, 279, 284, 293, 294, 295, 296, 305,335, 357, 569, 615, 629, 633, 691, 704: Xaa = Any Amino Acid
SQDYISLSHGVFLRNSHGLEILLRSQKLIWRTLGGGIDLTFYSGPAPADVTRQYLTSTVGLPAMQQYNTLGFHQCRWGYNXWSDLADVVANFEKFEIPLEYIWTDIDYMHGYRNFDNDQHRFSYSEGDEFLSKLHESGRYYVPIVDAALYIPNPEXASDAYATYDRGAADDVFLKNPDGSLYIGAVWPGYTVFPDWHHPKAVDFWANELVIWSKKVAFDGVWYDMSEVSSFCVGSCGTGXLTLNPAHPSFLLPGEPGDIIYDYPEAFXITXATEAASAXAGASXQAAATATTXXXXVSYLRTTPXPGVRNVEHPPYVINHDQEGHDLSVHAVSPXATHVDGVEEYDVHGLYGHQGLXATYQGLLEVWSHKRRPFIIGRSTFAGSGKWAGHWGGDNYSKWWSMYYSISQALSFSLFGIPMFGADTCGFNGNSDEELCNRWMQLSAFFPFYRNHNELSTIPQEPYRWASVIEATKSAMRIRYAILPYFYTLFDLAHTTGSTVMRALSWEFPNDPTLAAVETQFMVGPAIMVVPVLEPLVNTVKGVFPGVGHGEVWYDWYTQAAVDAKPGVXTTISAPLGHIPVYVRGGNILPMQEPALTTREARQTPWALLAALGSXGTASGQLYLDDGEXIYPXATLHVDFTASRSSLRSSAQGRWKERNPLAMVTVLGVNKEPSAVTLNGQAVFPGSVTYXSTSQVLFVGGLQXLTKGGAWAENWVLEW

SEQ ID NO: 167 - protein, 640 aa, Artificial Sequence
  Transgucosidase CAA25219.1
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 168 - protein, 985 aa, Artificial Sequence
  Transgucosidase BAA23616.1
MVKLTHLLARAWLVPLAYGASQSLLSTTAPSQPQFTIPASADVGAQLIANIDDPQAADAQSVCPGYKASKVQHNSRGFTASLQLAGRPCNVYGTDVESLTLSVEYQDSDRLNIQILPTHVDSTNASWYFLSENLVPRPKASLNASVSQSDLFVSWSNEPSFNFKVIRKATGDALFSTEGTVLVYENQFIEFVTALPEEYNLYGLGEHITQFRLQRNANLTIYPSDDGTPIDQNLYGQHPFYLDTRYYKGDRQNGSYIPVKSSEADASQDYISLSHGVFLRNSHGLEILLRSQKLIWRTLGGGIDLTFYSGPAPADVTRQYLTSTVGLPAMQQYNTLGFHQCRWGYNNWSDLADVVANFEKFEIPLEYIWTDIDYMHGYRNFDNDQHRFSYSEGDEFLSKLHESGRYYVPIVDAALYIPNPENASDAYATYDRGAADDVFLKNPDGSLYIGAVWPGYTVFPDWHHPKAVDFWANELVIWSKKVAFDGVWYDMSEVSSFCVGSCGTGNLTLNPAHPSFLLPGEPGDIIYDYPEAFNITNATEAASASAGASSQAAATATTTSTSVSYLRTTPTPGVRNVEHPPYVINHDQEGHDLSVHAVSPNATHVDGVEEYDVHGLYGHQGLNATYQGLLEVWSHKRRPFIIGRSTFAGSGKWAGHWGGDNYSKWWSMYYSISQALSFSLFGIPMFGADTCGFNGNSDEELCNRWMQLSAFFPFYRNHNELSTIPQEPYRWASVIEATKSAMRIRYAILPYFYTLFDLAHTTGSTVMRALSWEFPNDPTLAAVETQFMVGPAIMVVPVLEPLVNTVKGVFPGVGHGEVWYDWYTQAAVDAKPGVNTTISAPLGHIPVYVRGGNILPMQEPALTTREARQTPWALLAALGSNGTASGQLYLDDGESIYPNATLHVDFTASRSSLRSSAQGRWKERNPLANVTVLGVNKEPSAVTLNGQAVFPGSVTYNSTSQVLFVGGLQNLTKGGAWAENWVLEW

SEQ ID NO: 169 - protein, 985 aa, Artificial Sequence; identical to SEQ ID NO: 168
  Transgucosidase P56526.1

SEQ ID NO: 170 - protein, 639 aa, Artificial Sequence
  Transgucosidase AAP04499.1
MSFRSLLALSGLVCTGLANVISKRATWDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEVNGSSFFTIAVQHRALVEGSAFATAVGSSCSWCDSQAPEILCYLQSFWTGSFILANFDSSRSAKDANTLLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDATGTYSSSSSTYSSIVDAVKTFADGFVSIVETHAASNGSMSEQYDKSDGEQLSARDLTWSYAALLTANNRRNVVPSASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 171 - protein, 112 aa, Artificial Sequence
  Transgucosidase AAM18050.2
SSTSCTTPTAVAVTFDLTATTTYGENIYLVGSISQLGDWDTSDGIALSADKYTSSNPLWYVTVTLPAGESFEYKFIRIESDDSVEWESDPNREYTVPQVCGESTATVTDTWR

SEQ ID NO: 172 - protein, 640 aa, Artificial Sequence
  Transgucosidase AAT67041.1
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFRQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSGDPLWYVTVTLPAGESFEYKFIRIESDDSVEWESDPNREYTVPQACGTSTATVTDTWR

SEQ ID NO: 173 - protein, 640 aa, Artificial Sequence; identical to SEQ ID NO: 167
  Transgucosidase P69328.1

SEQ ID NO: 174 - protein, 985 aa, Artificial Sequence; identical to SEQ ID NO: 168
  Transgucosidase BAF37801.1

SEQ ID NO: 175 - protein, 655 aa, Artificial Sequence
  Transgucosidase CAK37022.1
MLYAEDNKLIFRFDDHLLWIQPWGENALRVRATKLASMPTEDWALSSKVTSIEPTISIEEHKDSSITNGKIKATVSQRGKITIYNQKGEKLLEEYARNRRDLKDPKCSALEVEARELRPILGGDFHLTMRFESLDPKEKIYGMGQYQQPFLNLKGVDIELAHRNSQASVPFALSSLGYGFLWNNPAIGRAVLGTNTMSFEAYSTKVLDYWVVAGDSPAEIEEAYSKVTGYVPMMPEYGLGFWQCKLRYWNQEQLLDVAREYKRRNIPLDLIVVDFFHWKHQGEWSFDPEFWPDPDAMIKELQSLNVELMVSVWPTVENASTNYPEMLEKGLLIRHDRGLRVSMQCNGDITHFDATNPSARAYVWSKAKQNYYDKGIKVFWLDEAEPEYSVYDFDLYRYHAGSNLQIGNIFPKEYARGFYEGMESAGQTNIVNLLRCAWAGSQKYGALVWSGDIASSWSSFRNQLAAGLNMGLAGIPWWTTDIGGFHGGDPSDPAFRELFTRWFQWGAFCPVMRLHGDREPKPENRPTDSGSDNEIWSYGEEVYEICKKYIGIREELRDYTRGLMKEAHEKGTPVMRTLFYEFPADKKAWDVETEHLFGSKYLVVPVFEAGKRSVEVYLPAGASWKVWGQEDVIHEGGKEIQVDCPIETMPVFVRV

SEQ ID NO: 176 - protein, 1539 aa, Artificial Sequence
  Transgucosidase CAK37087.1
MSSPQQVYLLPLKDDGSPDVPGGYIYLPAPTNPPYLLRFVIEGSSSICREGALWVNIPEKGESFNRSAFRSFSLSPDFNKNIQIDVPITSAGSFAFYVTFSPLPEFSVLSTPTPEPTRTPTHYIDVSPKLTLRGQDLPLNALSIYSVISKFMGQYPKEWEKHLNGISQRNYNMVHFTPLMKRGASNSPYSIFDQLQFDDAVFPNGEDDVARLISKMENEYGLLSLTDVVWNHTAHNSKWLEEHPEAGYSVETAPWLEAALELDTALLKFGQDLQNLGLPTEFQTVDELMKVMNVMRDKVIAGIRLWEFYAIDVKSDTHKILDKWKTSKDIDLTDTNWAQLNLQDYKNWTLKQQATFIRDHAIPTSKQVLGRFSRAVDLQFGAAILTALFGPHNPSTSDTSIVEESLSKILDEVNLPFYEEYDGDVSEIMNQVFNRIKYLRIDDHGPKLGAVTAQSPLIETYFTRLPLNDVTKKHKKEALALVNNGWIWNADALRDNAGPDSRAYLRREVIVWGDCVKLRYGSCRDDNPFLWDFMTDYTRLMAKYFSGFRIDNCHSTPLVVAEYLLDEARKVRPNLTVFAELFTGSEEADYIFVKRLGINALIREAMQAWSTGELSRLVHRHGGRPIGSFDLDLPSSGSSHAIASSGLDSGKEKVVHIRPTPVQALFMDCTHDNEMPAQKRTAKDTLPNGALVAMCASAIGSVIGYDEVYPRLVDLVHEHRLYFSEFSEAPETGLNSLEGGIGGIKKLLNELHTKMGIEGYDETHIHHDGEYITVHRVHPRTRKGVFLIAHTAFPGQDSRSVLAPTHLVGTQVKHIGTWLLEVDTSQTTKERIQADKSYLRGLPSQVKTFEGTKIEESGKDTIISVLNSFVAGSIALFETSMPSVEHASGLDNYITEGVDHAFSDLSLVDLNFALYRCEAEERDSSKGQDGAYDIPGHGPLVYAGLQGWWSVLENIIKYNELGHPLCDHLRNGQWALDYIVARLEKLSHKEEHPALGRPAAWLQEKFQAVRQLPSFLLPRYFAIIVQVAYNAAWKRGIQLLGPHIQKGQEFIHQLGMVSVQQTGYVNSASLWPTKKVPSLAAGLPHFAVDWARCWGRDVFISLRGLLLCTGRFEDAKEHITAFASVLKHGMIPNLLSSGKLPRYNSRDSVWFFLQSIQDYTEMAPDGLEILDHKVPRRFLPYDDVWFPFDDPRAYSQQSTISEIIQEVFQRHAQGLSFREYNAGPDLDMQMTQDGFQIDVKVDWETGLIFGGSQYNCGTWQDKMGESAKAGNKGVPGTPRDGAAIEITGLVYSALTWVAKLHERGIYKHDGVDIGGGKSISFEDWASRIRANFERCYYVPLQPKDDGQYDIDANIINRRGIYKDLYRSGKPYEDYQLRSNFPIAMTVAPDLFTASKALAALALADEVLVGPVGMATLDPSDLNYRPNYNNSEDSTDFATAKGRNYHQGPEWVWQRGYFLRAFLHFDLARRTTPAERTETYQQITRRLEGCKRALRESPWKGLTELTNKNGAYCADSSPTQAWSAGCLLDLYYDASRHSQS

SEQ ID NO: 177 - protein, 656 aa, Artificial Sequence
  Transgucosidase CAK43781.1
MWSSWLLSALLATEALAVPYEEYILAPSSRDLAPASVRQVNGSVTNAAALTGAGGQATFNGVSSVTYDFGINVAGIVSVDVASASSDSAFIGVTFTESSMWISSEACDATQDAGLDTPLWFAVGQGAGLYTVEKKYNRGAFRYMTVVSNTTATVSLNSVKINYTASPTQDLRAYTGYFHSNDELLNRIWYAGAYTLQLCSIDPTTGDALVGLGVITSSETISLPQTDKWWTNYTITNGSSTLTDGAKRDRLVWPGDMSIALESVAVSTEDLYSVRTALESLYALQKPDGRLPYAGKPFFDTVSFTYHLHSLVGAASYYQYTGDRAWLTRYWGQYKKGVQWALSSVDSTGLANITASADWLRFGMGAHNIEANAILYYVLNDAISLAQTLNDNAPIRNWTTTAARIKTVANELLWDDKNGLYTDNETTTLHPQDGNSWAVKANLTLSANQSAIVSESLAARWGPYGAPAPEAGATVSPFIGGFELQAHYQAGQPDRALDLLRLQWGFMLDDPRMTNSTFIEGYSTDGSLAYAPYTNTPRVSHAHGWATGPTSALTIYTAGLRVTGPAGATWLYKPQPGNLTQVEAGFSTRLGSFASSFSRSGGRYQELSFSTPNGTTGSVELGDVSGQLVSDRGVKVQLVGGKASGLQGGKWKLSNN

SEQ ID NO: 178 - protein, 1202 aa, Artificial Sequence
  Transgucosidase CAK37133.1
MSSDSQLSRSHFLAPPTVIPAPSYIASSAAAQIITADQEFNAADFVADDEGHDSSASALVTPEALSSLNAFLDNILFNILAAAKSTQLVKIRPAVAEVLKPRLAKEMVSAADDELSEYLGGPEDEQLEFRSGQTSIGEFDLVRSWKLTRLRCMVYTRLGDMEEDDEEEYINQEIIGEDGGGLRRLASHVGHITPAASIFLTSIIEHMGEQALIIAGEIARSRLSANLEDEDDLAGTGANRASMDRLVVEDHDMERLALNPTLGRLWRTWRKRVRGSNLSRAVSRESLRNRQSLVFGPGSRKSSAITIDEISPRTASSRSVNEPLPETEDEVDPASVPLPMSEHDIQEIEIPCFLPELDTGDIQTMQAVVAHKVRPHSLMVLTLPSPRSPSSNGNSPITPRLVNIKSPRHVRSRSLPNTAPADEQPSEVEQPAERTSPTPSEERRRLETMYEHDEDDERHGEAATKPEAVEQNEPVVPSAGQGAAATPSTSVASVEVAMSDASSTPVSSPSLSDRDYPETDEVEKHERVEKAQLAPGVETAPGPLAPRTQGVVDSTPAQPTAAADQDASKAADCDQSTPEDSTPPTVPSSAEDTAVEKASRPVSTSGESAISDSSRSLPGKRGSSVPGVQHQYGRSSPGIASVSSGVERAAVQRLPARPSTSVASSVYSKSRRSGSFSSSREKRPVTAGSTTSQVSSKLKGLIGRPADTGSLRLRTSSEVSRVSTRESAYDDTSGLDELIRSEETIHFTLTPRSMREMELPDSPRWRAQQASTDPTDLPKSVEPIPDDMSRSRHSTTSSKSTVDLPPVPKYIQSKPKSIEIPTTGLQQKPAVGQARDAKHSMESTRDFANFLKSTGPNTPTTPATVDGSPAKSSRLRRLSDATEISKKLSRPASSTVSVANSARSGPRLEARSAVAPRGDQTSDLIDFIREGPPTAGAHRIPRTVAPFRDTMDSDELQAIEPGRTAKGAPSVASTQSVAETSLVSVGSRTGLLESTSRTSTPTALAKETKTTFAAPVSVSDDHRPPRTRRRVPDPYAIDLDDDDELDELLEEPKPKRDEESLIDFLRNVPPPEPTPPQQPLAATANSRRGSASVKARLRRNTASEKTLMAKPSKTSLHQQPDNYMGGASNYTVKVGMERNAGAMNGAYDLKTPSVRQTETSALADFLKNTGPPEPPVTKAPAATKSKDSGFSRLFMRRKKVEA

SEQ ID NO: 179 - protein, 759 aa, Artificial Sequence
  Transgucosidase CAK37219.1
MAALVQTIPQQSGTVSVLQTRPSSSSGTFTTSSQPGQQQNPRNSTMSWNPYNNSGSSGNYRVGHQVVAPYAFTSTPNPSNPTNMQSRQSLSPHLRPEHRTSSAPSVPQGSASPANVGVNSRFAHPAAGSVSTSSSNSSVHSYMSKDDSAIPTRQIRTDAPLRPLSTVNLPSPSSSNFMNISSPTVARPSPDRYRRGNRRPENAAGAQPASTQPNGPAPARSATLATDDSSLHMSTPGLAGVSLDAPRRPGHVRVPSADDTTRADKPQTELAKRYRRRSWGNIDNAGLINMQLHLPTSSPTPTAGGHDYFDQSMRPRSAQSHREVQGSIPSAHSSTSSVRDAGHSESASSSKSGPKTDDSKRPNKPSPLSQPVEVDAKPPTPKAPQPSTTPQPAPTESLATQRLAEITKGDPKRPGKSRLRRAFSFGSASELLKASSQNKREAMATERARRELLQEELGPEQAAIAEQQEASGLGESIYSSHHQGRIFNSSTDNLSVSSTASSASIMLRKMGKGMKRSTRSLVGLFRPKSVVSTSSTDGVMIEPMAPQLSVVNIEAERKSTAVTSDSQDHALGSSLFSKVETDAANAVSHEDGALDKSRKSIVGGDRERAEVLAAVRKGILKKTYSDPANQTYVLKSSENLNSNDSPHSSVPSTPEDQTRSGNRRSDAVKIAGEDDYLSEGRFQTSESKSAPITPQAMMPKSLVFSPRIQFHETWPSGEYDRRGDIATCNRLTPLLAQQIKEELNNFKMVRNLLPLLPST

SEQ ID NO: 180 - protein, 590 aa, Artificial Sequence
  Transgucosidase CAK37226.1
MFVYCSNCSFALLFLMLLSLLSFTASRTLAFTTSITQDGLLCFPSALEFLLRTEITVPYWAPSGSILRPTAALHAYDCSVCLDPPSKIQEARKSVLMSANALSEIIDIPVSDGGFIHGVIRFYARGDHLRWLQPPTRDAKFLAPDPYLHSLMIESWRQTLGEMHFWTRAGYLFDVVLAEVKRSEPDNYEFLNWSGTNYMPTCPYYYVSMSPMVQPVVRSAQGSVDAAQRSSQISQDPSNLVQTPLHSPEFSDDSTRSSFNTAQTASSCQSFSSPVSQSPCHEDVIQQNVQTSQVSLPFVRMDPSVTLDDPFVIEPISAEGSWSMQDHIADMKRQFRLPGPMVRNASPSFDSPTPSTTERISAREINRRRDSEKPYDPTPLANDTSASCDDETWSMEDASEKDASESSFKDAVEAHSDSASSTATGPVVASKNDDDQSLPKCNTNDTQPTTCTTVNPSLLMFESSHKTYPTIEPSYEVAASRPRSLSPVQNLENELQVGSIGGKDAEDAGSLSFNDEMKEGSEMDLFSASLDQYTAEQLASRQLTRTPELEESNPNEYGLGFGFQHNLFDGFDFFLPEDQSELPLESNMIM

SEQ ID NO: 181 - protein, 865 aa, Artificial Sequence
  Transgucosidase CAK37273.1
MLGSLLLLLPLVGAAVIGPRANSQSCPGYKASNVQKQARSLTADLTLAGTPCNSYGKDLEDLKLLVEYQTDERLHVMIYDADEEVYQVPESVLPRVGSDEDSEDSVLEFDYVEEPFSFTISKGDEVLFDSSASPLVFQSQYVNLRTWLPDDPYVYGLGEHSDPMRLPTYNYTRTLWNRDAYGTPNNTNLYGSHPVYYDHRGKSGTYGVFLLNSNGMDIKINQTTDGKQYLEYNLLGGVLDFYFFYGEDPKQASMEYSKIVGLPAMQSYWTFGVCPPPPNPITVRVVVYNYSQAKIPLETMWTDIDYMDKRRVFTLDPQRFPLEKMRELVTYLHNHDQHYIVMVDPAVSVSNNTAYITGVRDDVFLHNQNGSLYEGAVWPGVTVFPDWFNEGTQDYWTAQFQQFFDPKSGVDIDALWIDMNEASNFCPYPCLDPAAYAISADLPPAAPPVRPSSPIPLPGFPADFQPSSKRSVKRAQGDKGKKVGLPNRNLTDPPYTIRNAAGVLSMSTIETDLIHAGEGYAEYDTHNLYGTRLVMSSASRTAMQARRPDVRPLVITRSTFAGAGAHVGHWLGDNFSDWVHYRISIAQILSFASMFQIPMVGADVCGFGSNTTEELCARWASLGAFYTFYRNHNELGDISQEFYRWPTVAESARKAIDIRYKLLDYIYTALHRQSQTGEPFLQPQFYLYPEDSNTFANDRQFFYGDALLVSPVLNEGSTSVDAYFPDDIFYDWYTGAVVRGHGENITLSNINITHIPLHIRGGNIIPVRTSSGMTTTEVRKQGFELIIAPDLDDTASGSLYLDDGDSLNPSSVTELEFTYSKGELHVKGTFGQKAVPKVEKCTLLGKSARTFKGFALDAPVNFKLK

SEQ ID NO: 182 - protein, 614 aa, Artificial Sequence
  Transgucosidase CAK96369.1
MSLSFSSDVALNATEAAVFLSERDVAGQIPINFVTTSAVSLRAACFGDNIYDRDAAGRCISNLLVVGYRRFLVDLYWSSDQRDWMFCPLSLSPDVPVVTVSSISPASSTTTTATSGITATTTATTTTTTTSETIKATVTAVARSSGSVLYELGPYRCSLDFDLSDLINVFRGFFQAYSSELTVFTRYISLNLHAAGSATSPDEPASTVTGSQLPTSSEFVSYQFDEHLSSYIYTPSSLASERANLNQSWYQVEDGYKPITEYFTIHEEPNGDQSTPDGWPCVKYLQLAQEKRLLIDYGTIDSQLQDYNFSYMSDVIFPPNYLTSTVSVSLDSDGSVDTGCFYDSGATTVSQANNSWAISDYIPIPEGLSENSTIAAMSLVASNLTACGLTPALNNTLFNQTADTHPQPYTDISLSSSWAWSIGQPANADSSSASFSATDRCAVIDLTNSGHWRAINCSQVRYAACRVGNNPFTWQLSPTPYTFRDAYDHGCPENTSMAVPRTGLENTYLYQYLLTRTDVLDPTSAIPNKTKVWLNMNCIDVESCWVTGGPDQECPYASDPQQLERRTVLVAAIAGIVICIIAALTLFVKCNANRRNSRRNKRVIKGWEYEGVPS

SEQ ID NO: 183 - protein, 460 aa, Artificial Sequence
  Transgucosidase CAK96386.1
MADSKPKPSSIPPWQQSNNASNTDNSSESTSSPTSDDTSRSTLIEQASKFLEDESIRDAPTDRKVSFLQSKGLREDEINSLLGISATSTASDTTEEEKAASPDTTTPSSTEPAPAPEPTDNASASSNQSTPSSSITTPTPSPSTTTPKTNNTRDVPPIITYPEFLSTPTKPPPLVTLRSVLYTLYGAAGISASFYGASEYLIKPMLSNLTSARQELASTATSNLQKLNEKLEQNVSVIPESLKNKTANVENDSSSTDTESITSDPTELFHRDVATQTATSDFAATYNNSNKTGTDKDTPADPTAAVTDHLKRLESIRSQLRECSDTEKESGTLESGMRTRLNELHHYLDGLIYSKPGFNPLSGYGMYSTPGIDSGSGAATGVGKGEEDAIANFRAEIRGVKGALLSARNFPAGRGGRIGGVAGSIPTGLMRMNRVVNGIGSARPKKERYKHSPTTFRYYQ

SEQ ID NO: 184 - protein, 537 aa, Artificial Sequence
  Transgucosidase CAK47557.1
MGVGDYVHSKEAGQPRPRTTEVSNQSRQAVAAQARIDVPPTNLVAPVPLPINKSIPLEHYSTPAFSEQMPQAPAENGVHRDMFDTDVEGIDESTIAATSVMGAEDAPLQFQLRPATVPQYQEAAPVVDERPLHPSRLPRRAYDGKWYENFGDKAMKSAGFDSEDADDASQLTSMAGDDERSDTTEDANYARRYRSSTEEPLSKRLQSFWSASRRSYKNPEPQAYPEPSKTAASAAPPLLRQSTSDARLSKQALPNRKVTLPRSMTATPRTRFSPPKPSLLEQLDITPTRRTSGPRPQPGKEPGITSTTTHQHHRHNSDDNHLFNTSRDSLPPLSTFDMTNIDDLDVDDDNDPINDPFARRNSVQRIVSDPDFQPNKSTITSSSSQNKRRNLESDYPPEILRQKSFKDLQSEPFDHTPTATASAPVKTTTPAPTPGPNATSDEKMDFLMNSEDKDRRDFFSTLTMNEWEDYGDLLIDQFSDALSKMKDLRHARRKTAALFEAEIARRNEVVEEQSADLTRKLEEMRSGGAEVLKGRTP

SEQ ID NO: 185 - protein, 471 aa, Artificial Sequence
  Transgucosidase CAK47704.1
MQAIEQAGSIFTGWISSCLFCLSGRGDDESFHHQQAMKQKGVEREMRVCHTQPHLVPPMNLTDYDDLPSPSSQPRVSSLQSWVVEGRTRASRASNRASMSLKRKSTAPVRISGPSEFRRVSMFLTELDEYRPLELSFNTPGNRLPDLPRFEDFPLDHDRKQVISRPPRALSSTEMGRISQPRTHRPSSSFQLARKPVGSGSRRSSLPTQEQLQLLEKNTPITSPLIPHFSQRSSAVTGLTANAVPSTTPRLDLSGGSTSLARNELHRDTHEAPTSTVPRTPTKPSLQDRPLPSIPTEEDSPSSGSTYHPPTTPSESRPPTTPSENPNQTPTRSGRVTQWLFQTPNKPNFLFSNPSKISDKGPFRIRSRTLSGSTLASTTTNITGGHKTTPSLASGTTVAPTMQASSTESRNFDLPLGSPFSPKQTFPTVTEEHTYPTIHEGEQQQHQEPEVFDDMLTQYYEYRHSAVGLAF

SEQ ID NO: 186 - protein, 220 aa, Artificial Sequence
  Transgucosidase CAK44239.1
MKIFILLAIWLLASLGYATSFVGNMAEVYHEITDVLRGPHHAAHFAKLNGGKPKPDKPKGVGKTLDDVVTLTVCKTDVSLAPTVGTFSLPTIVTAATLAPTVVVTGVVPTEISIGLPTEFAPEIQTGVLTGESHSTDTTVVPTNSVVSGLSSFLTGSQTVSEITGSTENHTITTEINASAVTSTFAHTTFPTANAGNDHEGMASSAVALLVALIFSLVRI

SEQ ID NO: 187 - protein, 1106 aa, Artificial Sequence
  Transgucosidase CAK44326.1
MRTRSQQASPGGFVSLDENAPRRTRSAKNAAQQEPATSEQPPTRSKSQRAPKKTTTTTTTKKSTAKAQTRKATTTKRTTRQSTRKTDQPVSNEDAQTTHTEEDFATDNTTAEKNTPREVPETVDPTPASSENENPDRESLPHVSHPFMVPQPPKESQEIDCFDGPDPRGIGAASCLKSLIDELSSVGSPLSERSKTPSWTSEDGTEAALAPRPAQESGATNVETSTTTERVSLPTPAAEERTVEPPAEPTVAEPRGVAIVTSSEQFNTVSSASAAGSGGVVVVEDERVGALIASFARLSLDDLAPRSSNEAAATLMESTTASFGEPVEPAHVTRRSLRASRQEWILGWAQQVPSTGYFHPITGQLVEGPAASVELVGDPASNRGPPTRRIGVRDYILRRRRREVQVMSPLQEEPQSSPGPGSRAVALNAVPPRGIRAQRAQNTKRLTKPPVTRKRARTESSDEEAPGPQTPAANKRRNLGPPGSTPYRPATRPRSLTANITPYSERLRRRAAEKDGRIHSTSLRVSQLLAQQEADRRRQAAESSAPPCSELPRTTFDFSLDDAHETSQGQEQSQSLQEQSSTPQPPATPERQSGWNIRGLLNSVPRTFTRILPSFRRTPEPTQVQAPPEPSSERISRTQPPQSSSISQSQAQNSRRSSEEPPQKRRRKSWSLFAQPFDRSLYLGDIPKKDSATSSSAPLESRPVAKLSAEATTPQESATSDAKKDVAAEGEDSRGREIEEQKQKKRKRSPSPDVIPNPPGCSYGLDLDYFCYSSESEDEQEPPLPRTEPNKFGRLTRTAVRGALRSERHSSKKVRFDASPEDTPSKLRLRARATDPYRGRHFIGMGNDSEIATPDSPTPAPHAADESSSRRPGFVPNVQGTFQLDYDAFSDDSDSSGASASANVSASAPIPAPSSATVTQASISESVPSTESRQTPRQAAPAPSTPAKIDEEALARARSQAEKYKPKTPSGLRTASRYSSPMTATPDTVSAPVIAPAITPTPSTSQTAPASAPEPEQQTTEDFGDDEFAREAQWLYENCPSGDLNDLVWPQPITYEEEGFSPEVIDLVNEIWDPSTVDYAYTNIWTPGLDAFKRELETGASEAAQA

SEQ ID NO: 188 - protein, 587 aa, Artificial Sequence
  Transgucosidase CAK47737.1
MAKSASQIHRAWWKECSVYQIWPASYKDSNDDGIGDIPGIISKLDYIKNIGVDIVWLCPSYKSPQVDMGYDIADYYSIADEYGTVADVEKLIQGCHERGMKLLMDLVVNHTSDQNEWFKQSRSSKDNKYRNWYVWKPARYDEQGNRHPPNNWVSHFQGSAWEWDEHTGEYYLHLYATEQPDLNWEHPPVRKAVHDIMRFWLDKGADGFRMDVINFISKDQRFPDAPVKDPRTPWQWGDKYYANGPRLHEYLQDLGKILKEYDAFSVGEMPFVRDTEEVLRAVRYDRNEINMIFNFEHVDIDHGTYDKFEPGSWKLTDLKAFFETWQKFMYNNDGWNALYWENHDQPRSIDRYAQAKEEFRTEAGKMLATVLALQSGTPFVYQGQEIGMRNVPVEWDMNEYKDIDCLNHWHRLLKHRPDDIEAQKSARQEYQKKSRDNGRTPVQWSSAPNGGFTGPNAKPWMSVSPDYVRFNAEAQVNDPNSIYHYWAAVLGLRKKYLDIFVYGDYDLVDKDSQEIFAYARQYENKKALVLTNWTEKTLEWDATTNGVKGVKDVLLNSYESAEAAKGRFSGQKWSLRPYEAVVLLVEA

SEQ ID NO: 189 - protein, 416 aa, Artificial Sequence
  Transgucosidase CAK47819.1
MAYYEPQGWQAPAARQASWEQPAPPSRSGSSSVSQRDEIPAFSSQFDEVDRAIDNLVKSGKLWAAPRRDSMPMMMGRPYPDYDPRMVNSMSQRHHSISEFDSRMHPSPNVQGFYASQRFQGRPNEVEQMMQAKRRMAAQRERELRNYHQEQQYNRSLLAEMSGNKSDRSLSPAAMSEESRRELLARQHRALYGNDSPAFFPPAGLADDGTRSESQAGGTPTSSTGVRGASPRNVDPFGLAQTPVQAGADSLGQTAASAASLQSPSRANSTSSPSSAINPVFGKYDSADQPVTSTSSPGGADSPSSRQAPSKSMAGPIGSVGPIGTRPLPQPHAGQVSNPALNKRSTTPLPSPLGFGFTPGDAASDRSVPSVSTAPTTAAATASVKDTSGGVGLGWGNGSGVWGSKNGLGVQASVWG

SEQ ID NO: 190 - protein, 464 aa, Artificial Sequence
  Transgucosidase  CAK49181.1
MLSKMQLAQLAAFAMTLATSEAAYQGFNYGNKFSDESSKFQADFEAEFKAAKNLVGTSGFTSARLYTMIQAYSTSDVIEAIPAAIAQDTSLLLGLWASGGGMDNEITALKTAISQYGEELGKLVVGISVGSEDLYRNSVEGAEADAGVGVNPDELVEYIKEVRSVIAGTALADVSIGHVDTWDSWTNSSNSAVVEAVDWLGFDGYPFFQSSMANSIDNAKTLFEESVAKTKAVAGDKEVWITETGWPVSGDSQGDAVASIANAKTFWDEVGCPLFGNVNTWWYILQDASPTTPNPSFGIVGSTLSTTPLFDLSCKNSTTSSSSAVVSAAASSAAGSKAVGSSQASSGAAAWATSASGSAKPTFTVGRPGVNGTVFGNGTYPLRPSGSASARPSAGAISSGSGSSSSGSGSSGSTGTSATSGQSSSSGSSAAAGSSSPAAFSGASTLSGSLFGAVVAVFMTLAAL

SEQ ID NO: 191 - protein, 846 aa, Artificial Sequence
  Transgucosidase CAK49185.1
MPCVQAAAETDKSFVQIANADIEELIKQLTLDEKVALLTGDDFWHTVPIPRLGIPSIRLSDGPNGVRGTRFFGSVPAACLPCGTAIGATFDRNLAVQVGHLLAAEAKAKGAHVILGPTINIQRGPLGGRGFESFSEDPLLSGIIAGHYCKGLKEDNIVATLKHFVCNDQEHERMAVNSILTDRALREIYLLPFMIAIALGKPEAIMTAYNKVNGLHASESPALLQGILREEWGWEGLLMSDWFGTYSTSEAIHAGLDLEMPGPTRWRGGALTHAITANKIPMATVNARVRAVLRLVQQASRSGIPERALELQLNRAEDRQLLRKIASEAVVLLKNDDNILPLDKTKKIAVIGPNSKIATYCGGGSAALNPYEAVTPFEGISNSASGGVEFAQGIYGHQNLPLLGKRLRTQDGLTGFTLRIFNDPPTVANRVPLEERHETDSMVFFLDYNHPKLQPVWFADAEGYFVPEESGMYDFGLCVQGTGKLFVDGKLLVNNANVQRPGPSFLGSGTMEERGTLELTAGRQYKVHVQWGCAKTSTFKVPGVVDFGHGGFRFGACRQLSPHTGIEEAVQLAASVDQVVLVAGLSAEWESEGEDRTSMGLPPHTDELISRVLEVNPDTVVVLQSGTPVEMPWIQNAKAVLHAWYGGNETGNGLADVIFGDVNPSGKLPLTFPRHVKNNPTYFNHRSEGGRVLYGEDVYVGYRFYDEIEIDPLFPFGHGLSYTTFELSGLSFERDSNSLHAICTLRNTGSRAGAEVIQLYVAPVSPPIKRPQKELKEFRKVWLEPGAEDVVQIPLDLVRATSFWDEKSSSWCSHSGTYRIMLGTSSRGAFLESPIELSETTFWSGL

SEQ ID NO: 192 - protein, 640 aa, Artificial Sequence; identical to SEQ ID NO: 167
  Transgucosidase CAK38411.1

SEQ ID NO: 193 - protein, 782 aa, Artificial Sequence
  Transgucosidase CAK47899.1
MDPNTSDRLKRLQMENLGTARREYISTADDRRHKKARLEDIQAIRMTNVPGSAAQRMATVNQGRLEDWANVHKTIGDTEDLENLDSLLDGQSHRLQLSAIIRESGGQKYIGSQRRSGSAPATRSLHPVGRGGGVIGTRGRGTRQSSLPPSNPTPRGHVTQPPKRSHGDAALDDNDFYRTAREGNASRKEEAMRAQNRRSSVRRPTSSTTRPRRPVSQVDYSSMLSQPQSFLAAARSLVSARTTPAAPTPASQISRDGGRSEASRKSSSPMDTTDRPTVQKTQQEPKPQMAEPPKPFTRPVVQLPAIPPRCTAVQQESTTKADEPLPVLPSSAVLDATSQDQGSASMSLGSTEDGQSISGIPESQTGTQEKVNSDLSTAAAPVPDIKDTSPKAATDVKEAILLDFSYTPPEQSIHGQSPAPTEVLTPSLEDLRGLDFKQDIHPKFPTRRRVDFDMSSDKREASTNVHDLMPTKQYDKAEASEDLHRQINMLCELLQSTSLSGEHRESLKQCKTALEGKLHGAYDSTGKRTQTQGDPFLGKPVLETLEAAAEPDEQPQSTISGLGIQNVSMDNFTPNKAETIVEPDTQATPSVGEMIMPTSVENARLAMASPSPSSRLNVTAPPFVPKTPFRAQSNSFSSDSNATCVPETPCPHRRVSMPEGHIIGDHLLPGRRRETISSGTEPLAAKQPPANEVTEPRFKFSIPPKISRKLTIKTPVREGFGKEETPGPVAPRLASGNIPKPAPKPSAALQQSVHAPKAKPSSVLGGLESSRYASPSSNKPFR

SEQ ID NO: 194 - protein, 1042 aa, Artificial Sequence
  Transgucosidase CAK38738.1
MPPSTVFAYWRREHRRSSASPVSPSLQPTSKAPVTSNPPQLPGLSSTRPNNLTALGASSVESSSPQVPNNPHEDYYDATKKTIAVSVAPANAPGSSSANLAIPSSSSDSHTRPLSISDEQDVTTTTSQSNYSQSSIAPPRSDQSDGDSPKPSSPFRLSLGKSLLNSHNLTSDHYNKRSSTPGLSSSGHFRFRTSPDISPGDRMALSHKDKDKEYKYEGAGNRRSADRDGSSEQAHHKSGRTRLHLLNPMSLLARRRSSNLASLRTEDTRVGARNIVPAIPDDYDPRIRGNIVHDFSAPRPRRNLSTAPVLMHDVNNQSSSADVTYNGTGNFAHGNDQSAQSGEQRKRHTQYSPVFREHFEDDQKVLQVESKAYLQSSLLTAQTNAENDPHTLPVFARKLPSKIPEQEVSPEVPSDQTTLKQDSQHSPPNNSRELAQEDTDTIEVIPHQPSGLPKHLKSNASRFSFDMNGVESSAQEKLLEEKHKEKEAARRAKARMEGTSFSDGEDDFDEDLLDDMDDLEEKIPGVNVDADEDDDFSGFSGPGNALNKPWLAPELSPIIASPLPTGSTNSQNVQELAQGPLAGISAPLPVSDPAVSDVTTNFQALSVATIAPNNAPQVAMGSHPPAPQPIEDDDDLYFDDGEFGDLSTEDMGEKFDESIFDDETSHLYERKPVVQQPVPAPVPPPDNGTGSTNPLDVTAEHDEFTPEPDYDGGLRHVPSMASDYRKGSIRVYGQTRESLANLGSAKAQGGVLSEHNLEAFHNALAKAASEAAASDRFGREASISEQSLGQESTAQTMDTPSGLVSDDSRLSQTVDMAAFEEVFEDFSYDDNDDALFDDPIIAAANAEALENDDEGFYGQEFGFYAQAHGGCNGELTNGGYFGPRGVEGVNRSFSSRGKFREPSLTPITERSEWSTRNSVISLTAHGAAHSNPIASPGLAQLVDLGAMDDEMSLSALMKLRRGAWGGSNGSLRSSSGSPPLLHSTSNRASFISDASPTVYTAPPDAFGGSATESPIRESDKFRWSLNNTEQRVGQSAAGEREP

SEQ ID NO: 195 - protein, 1396 aa, Artificial Sequence
  Transgucosidase CAK38790.1
MLVEPLIRTDWPVWACKPHPHLVGPEAVAKNRNRSALQPSLAPSQSLVVLAQSNLPPAFQPSALSHGSVFGWPCILPWRSSGNAGDEPPSGPYSYSGWPTPLTSSNQPSPSRREHAVQPPPLTTSLGGHQFQGLGLALGSGYSSTPLSSTSLSSPFTQGQSPAVGSPGGAAIGSSPMASRQYNVPYNPQDWGPVGSGSMNAGQATYTPPNSMLRIVSQPRSTGPHSDVSLSPPPPPYSPPSQQHQRENVSQNTSSMGSTSPSISSSYNGAVRAGVDAPSEYRQRRLPRTRPLSMFVGSESSHNRRVSLPPPPPLPPGLSSRSSSQNRSETYREPASVMAGPGPHIVVSPDNLHSTQLSDDSNMLEPTQPFDTDRPPAARRAVSAGPAVNSASSSRAHSQSGARSPPGTSWEPGMPLPPPPPGPPPATRSQSVNGLSDSSSSRNSQGPVRGGRARPPPVLGTSLDSIPPTPAGWVDETIDVKPRTERQPLTIDTATTSNTNGPESLESSRASHNPNSGGLFRSPAIKDPNAKGIRERRIERRNRQSQVLDSLSAVSMSSNPWAEALEQLKPSNLVLGESSVDTDNGRNPASAKAAPLSTRSISSDGPQITSRSRASSGGLFSNRSCSTPKPEPSPQAPTSNSRFAQTPPFSPGTERSSAFPKRTSPALPPKALPTPPLQSGSETTPSRPGSKEERPVSHILHLPNEPVTTVSPLAPRRVSAQQNPSLDSVIKRDDDYVRNAIQRHREFIEKEAGTMDEKEALRLFADFIISESQIRRERYAKVWDLDSFDVESVRRKLFVSPPKTAPVPQTSQVVPGPSSRRASNPTAPKLDIPQVRPESAWWNNYQPCLSPIASLGLSNDEMSSRGRAPSRWWESKTGSSSEGGERRVQRSKRETKYMGLSRGALLWEESQGSSDTGNAGTSNGGNQYAAYGPDEYPPEKVGWHEEPALEDYSNNVRLGSSRRFEEVQRMDVSRLITLPPPYPRHYPAVNNSHPDLVTYRTLVRSITDLSEIKTARQRHQTEMDGLFQDHQARVREGRRQFKANIQSQIQQGSITFAEAAEAEAALIVEENRLERDLIKGGLDTYQESVFKPMRAILADRIDRATACIDELRGRLFDDARSETPDQTQEEGDEKPELLEKLTQLKWLFEAREQLHREVFDLISDRDEKYRAVVLLPYKQASNEDKVRETNEFFVKDALDRRVDYEANALARLESFLDVIEGNVARGVEIQLSAFWDIAPSLSELVQQIPEKLRGFTVQIPANEYEENPSYRAHPLQYLYTLVSHAEKSSYQYIESQINLFCLLHEVKSAVMRASCNLMEAERIRLGESEGKVQQEMQETRTDEERTLTSDLKDKVATVEGQWAEALGSGIQRLRERVKEQLMVEDGWEDLEQLEQA

SEQ ID NO: 196 - protein, 786 aa, Artificial Sequence
  Transgucosidase CAK38810.1
MVTQSSLLDRVWLYTHKRSPILLALHPPSQSSLISSEGHLEEQTEPTVQSRRYIPNTIMNTNMHPQSLDSVRSGEEAKSENEDSNTRSGAISLIRARTISRSSTPRDTQEGCSSEQADDSQQAVSIPRIVVMEPPGDSKAKRNKMKKNKYKKKKLLLGDSESETSGSQGSGLNGKPTAESNTSNDTSSHMKEIEDLSHSAWMPAKGLNSGGCANKEKPMSGSNVSERCTVDSDKKRDLIESLSKLDIKGKQRVWQVNAVTGNDTLEEINTQRGPQPVDRARRTVLAPSYATVLSGKRASIEGPSSMPNNSDSLLPTTMEFPKLTDKTSAGQDSSPEARSGHAKLSPIPEISGEFAGDNSNDIPLSQTDLETAGSSSLDNPISTPVSTVSTGWSSTALQISPQTTEPSSEPSSSKAVSHRHATSLHHAHPLPPTPPSSTHSHSLSTANATITNAQGTLSAQKPEGFFWQLDSHGFPCAKAHCEKRCNLWDGATVICPRCGPYSEVRYCSRAHLLEDIKPHWLYCGQMVFQHPCRETSIPRRVRAGPPLIPCLHHYDMPERHRQAVHFNMNAREGDYFIFTDWLDFVTAGLPGDKTAIRCSNRIMYVVKFDDAAEKDRFRRVLAACLFMTIELPDLTDYLYRLIRDKLRLANAPNHIEPSLRYQFLQEFNVTIQERITGSRHACETDWDGRNRRNCQDPVCRAEYRRLLGSVGGRGYSRMIETLESTYWILRAARTTHPSVKDAMKRMMGEGYAEVAEEDRRAFRRGDGWDGAGSGDMEIEGFNEGDE

SEQ ID NO: 197 - protein, 394 aa, Artificial Sequence
  Transgucosidase CAK38817.1
MLATPMTPQASHPSSSNMVCSLASTTTTTSSSSSSSSSSSSSSATQQTTISSRPKLTLQTTSLPRTFGTSSTGLSLSIAAGTASPTVRNTFKNAYEVTGPSSATASPSSKHPSNLRFSKPSSPFTTHNPYQLPLGVKSILRNSPLEPTCRRRAGSVATTGPNGGPSARRVFFPAKKQVSYRNPLEEEIQTVHYTARHSDLHDDPEPALEPQSQPQQPEVTSSDEDSDSNASGCPSDTSTSEDEPETGLGKTTSSPIKRKKRKHSNAERQVRAVALMDGIAGPSNPDSLTPQTPRRKRAKRRCEWRWTLGPLENRDKLLHPVQDETGPTSSASQPETIPHESETETPSSDPPLSSASTTLYHSSPSSSVSSDVETENDEWQTHTTHELECAHADQ

SEQ ID NO: 198 - protein, 155 aa, Artificial Sequence
  Transgucosidase CAK38846.1
MAFWGVAEREVIERAVALEWADAAQVDERKESPNIRGVLSAGPSQPSRGDASEIKPGFGFSSALLWGAIFGAFGWTRVLRPVGRIPTRDSCSDRSDGTSWKRYLDLTLLSLDEPPTKGTKELEGQRKSQRARETKWALGSRGEKWALPELIILDD

SEQ ID NO: 199 - protein, 985 aa, Artificial Sequence; identical to SEQ ID NO: 168
  Transgucosidase CAK44692.1

SEQ ID NO: 200 - protein, 503 aa, Artificial Sequence
  Transgucosidase CAK44966.1
MLANSLVVLAAIVASILNPVLGAPALDVGVTEPQAEPKYVFAHFMVGIVENYQLEDWITDMKAAQAIGIDAFALNCASIDKYTPTQLALAYQAAQQVNFKVFISFDFAYWSNGDTGKITAYMQQYANHPAQMQYRGGAVVSTFVGDSFNWSPVKQATSHPIHAVPNLQDPAAASSNSQRGADGAFSWYAWPTDGGNSIIKGPMTTIWDDRYIKDLAGTTYMAPVSPWFATHFNSKNWVFICENLPTLRWEQMLSLKPSLVEIISWNDYGESHYIGPYSANHSDDGSSKWANGMPHDAWRDLYKPYIAAYKSGDSKPTIPQEGLVYWYRPTPKGVNCPEDNMPAPNGFQMLSDSIFVATMLSSPATLTVTSGSLGPVKVDVPAGIVTTNVTMGIGAQTFQISRNGQVILSGKGGLDVADRSKYYNFNVFVGSVMGSSAAGNASRMLLLLHTTLLKVLLSGDKQVNVCSTTGSKGVICHLLIPDQVTSLIIPKFLQHIVQGKKYN

SEQ ID NO: 201 - protein, 363 aa, Artificial Sequence
  Transgucosidase CAK47997.1
MKRLMYLLVVLLLSYVVCALPYDDHGKKRDLGPLSDLPGGDVIVWVDQAGNALANNVVGGGNSDPTATADNSPTTLPPILSTLDGDLDLSPAVPLPASTNLPKTGNYRRFGISYSPYNNDGSCKSQDQVDEDLDKLAQYGFVRIYGVDCDQTNKVTKAARQRNLKVFAGVFDLQNFPSSLDYITGAANGDWSVFHTINIGNELVNDGKNSAADVVNAVNTARSKLRAAGYQGPVVTVDAFSVMIQHPELCQASDYCAANCHAFFDNNNTPDKAGQYVKDQANKVSKAARGKKTLISESGWPHNGQPNGKAVPSSLNQQKAIASLQQTFTGEDELVLFTAFDDLWKQDSSGTFGAEKFWGIQKH

SEQ ID NO: 202 - protein, 865 aa, Artificial Sequence
  Transgucosidase CAK4847.1
MPHEERVSSHVRQLLQSLTLEEKVALLAGKNMWETVNIDRLHIPSLKMTDGPAGVRGSKWTYGSLTTWIPCGISLAATFDPAMVEQVGSVLGQEARRKGCQVLLAPTMNLSRSPLGGRNFESYGEDPYLVGVIATAMIRGIQAHGVGACMKHFILNDTETRRFNVDQTIDERTLREVYMKPFTMVLNDPASTPWTAMVSYPKINGLHADISPHILPRLLRQELQFDRLVMSDWGGLNSTAESLRATTDLEMPGPAVRRGERLLAAIRAGEVEVAAHVDPSVRRFLQLLERTGLLGDATKSAEHSEAATDDPIFHRIARDAAQSGLVLLKNDKGILPLKPTTLQRVAIIGPNACQPTAGGAGSAAVNPFYVSTPESCLRDVLHAANSELQVSYEPGIPSSLRPPLLGKLLTVPDGSRKGWQVSFFEGHALEGPVVASSMWDDSLIYLFSDGDVPAVLDDRPYSYRATGVVTPQESGRYTWSLANTGKAKLFVNDELLIDNTEWTGLTGGFLGCSSADKTASVYLEAGRAYQLRVDNVVTLPVVEAFDNTLFPRISGVRVGLALEQDEPEMLAQAVAAARQADVAVVVVGHNKDSEGEGGDRATMQLPGRTDELVAAVCAANPNTVVVVQSASAVAMPWVDAASGLVMAWYQGQENGHALAAALLGDCDFSGRLPITFPRRLKDHGSHAWFPGEAAQDRNTFGEGVRVGYRHFDAQGIPALWPFGFGLSYTRFQLTNIRVCGRVEGRSPESQPVLIQARVCNVGGRDGQEVVQVYVAPSAGIREAGEMSFPKTLGGFCKISVPAGDSREVSIPIRGSELSWYDARVAQWRLDAGKYACWVGRSSSHIDAELEIEVAEGEDTRQGTLE

SEQ ID NO: 203 - protein, 915 aa, Artificial Sequence
  Transgucosidase CAK39248.1
MQVLRCGIHGFHEVLGIDVDEIRFYWTIETDDKHASQLAYRVVLSTDEAAVQGDAIVESKLAWDSGRVMSNEQRNIICKPDNGFQSTCSYYWRVTLWDQSERPHHSAVNHFFTAYPRSHLLPPYSMNQTYMPHTSLIFRSWFEDEPNRWKAVWIGDGGDKPIYLRKAFDLAQPPARAIMFASGLGHFNMTVNGSPASDHRLDPGWTNYHRRVQFTAYDVTAQLQTGANVLGAHLGNGFYAGDKGEDRFFWPMYEDNTYVRYGNELCFFSELHLFYPDGSHTTMISDPSWRVRRSATSLANIYASENHDRRQYPTGWDTPDFDDADWAFAKPLTGPRGHIYYQTQPPVVLHETFQPVKITEPRPGIVCYDLGQNASTMVRVEVEGPRGSEIIVRYSETIQEDGTVLMPDPLFKEYETGVFSRIHLAGTGAPETWEPDFSFTSARYIQVEGVSLDGSDGRPVIRSVVGRHISSAARRLGTMQTDKEDVNQLLSALSWTFSSNLFSYHTDCPQIEKFGWLEVTHLLAPATQYVRDMEALYTKILDDILDTQEPSGLVPTMAPEIRYMCGPLHDTITWGCAVCLLPDILREYYGSTHVIAKVFPAAVRYMEYMRTKERRGGLIEHGLGDWGRGIAFGNNQANIETAIYYRCLQCVAMMARELGEMQKAKEFEQWAARIYAVYNRHLLVTDDASRPYAYYTSLDNYPARDRDAIAQAMALQFGLVPEQHRKDVMAAFLDDVADGRIRAGEIGLRFLFNTLADAKRPDLVLQMARQEEHPSYMRFLRRGETTLLEFWQDECRSKCHDMLGTIYEWFYAAVLGLKPTGPAYRTFVVDPPYNAEFKHVKGSVDCPYGTIAVEFTRNEQGQAVVNVRVPFGTTAIVKLPRSGKSSAYCREGEESRAVDGGEVSLSHGVYSIIEG

SEQ ID NO: 204 - protein, 768 aa, Artificial Sequence
  Transgucosidase CAK39259.1
MPSTYLGALATLAVFPCLGQARSTWPLGSGLELSYQASQHQISIHQDNQTIFSTIPGQPFLSASAGKDQFVEDSGNFNITNVNQARCRGQNITQLAGIPRSDSVKNQVAVRGYLLDCGGEDIAYGMNFWVPRRFSDRVAFEASVDSEANASVPVDRLYLTFASHALEDFYGLGAQASFASMKNRSIPIFSREQGVGRGDQPYTAIEDSQGFFSGGDQYTTYTAIPQYVSSDGRVFYLDENDTAYAVFDFQRSDAVTVRYDSLSVHGHLMQADTMLDAITMLTEYTGRMPTLPEWVDHGALLGIQGGQEKVNRIVKQGFEHDCPVAGVWLQDWSGTHLQSAPYGNMNISRLWWNWESDTSLYPTWAEFVQTLREQHGVRTLAYVNPFLANVSSKSDGYRRNLFLEASQHRYMVQNTTTNSTAIISSGKGIDAGILDLTNEDTRAWFADVLRTQVWSANISGCMWDFGEYTPITPDTSLANISTSAFFYHNQYPRDWAAYQRSVAAEMPLFHEMVTFHRSASMGANRHMNLFWVGDQATLWTRNDGIKSVVTIQGQMGISGYAHSHSDIGGYTTVFEPPTTSNSSGAIPRSAELLGRWGELGAVSSAVFRSHEGNVPSVNAQFYSNSTTYAYFAYNARLFRSLGPYRRRILNTESQRRGWPLLRMPVLYHPEDLRARQISYESFFLGRDLYVAPVLDEGHKSVEVYFPGHSANRTYTHVWTGQTYRAGQTAKVSAPFGKPAVFLVDGASSPELDVFLDFVRKENGTVLYA

SEQ ID NO: 205 - protein, 662 aa, Artificial Sequence
  Transgucosidase CAK39383.1
MAGVNRSFSYSRGDDALLRDDEREISPLRSAEDGLYSTSYGDVSPLSAGVQAQNRPFDRGLVSVPEGQTLERHMTSTPGMDNLGPASVGGGISDVPVRNLPAERDFNTTGSDNPYIPAPPDGDIYPSSEAVRYRDSYSSHTGLGAGAPFAEHSTPGTTPSQRSFFDSPYQGVDAGPYQRHSAYSSHDYPLVINPDDIADDGDDGFPVHPKGAADYRSNANVPGTGVAGAAAAGGFLGKFRALFKREEPSPFYDSDIGGGLGGAEKAQGGRHIIGGGSRKRGWIVGLILAAVIVAAIVGGAVGGILGHQEHDGDTSSSSSSSSSSGTGSGGSDKGDGLLDKDSDEIKALMNNKNLHKVFPGVDYTPWGVQYPLCLQYPPSQNNVTRDLAVLTQLTNTIRLYGTDCNQTEMVLEAIDRLQLTNMKLWLGVWIDTNTTTTDRQISQLYKIVENANDTSIFKGAIVGNEALYRAGSDVASAETNLIGYINDVKDHFKDKNIDLPVGTSDLGDNWNAQLVSAADFVMSNIHPFFGGVEIDDAASWTWTFWQTHDTPLTAGTNKQQIISEVGWPTGGGNDCGSDNKCQNDKQGAVAGIDELNQFLSEWVCQALDNGTEYFWFEAFDEPWKVQYNTPGQEWEDKWGLMDSARNLKPGVKIPDCGGKTIT

SEQ ID NO: 206 - protein, 667 aa, Artificial Sequence
  Transgucosidase CAK96650.1
MSRNFHPVNTNFPSTTTLTADPDIIPSPEDNRNNYTSTQSYFCRQDVSTNPTFNSNDQALLDNCSNIDVSQLVTEANCFWGSRSSTLPKNEGYPSVEEYPSTYLMGNHGHGYADENMHETSAPYGPCDHLQVAGAGMDMEMRMTGNVMGKVDETYEANQAAMLAALGMTHLDEGVSHAADDDAKTSSSVTVDDDPEWKEWKKWKEREANGGVRLPPEERMNQADVAAWLGMDSKEEHGVFQTQEEDDYDEDETISYVSDDDMMEMEEGMEDDEVVVNVVEGPSRQVLISSQTGAHAEYDTASFGCDFEEQEEQEDSEEQENEERWGGDGQPPPSLFPRFYSDNAETGLIIELSSADSDAEETMSDPSPSSLSSSSSSSPSETPLQPHLQEAYALPWTTSPSNTSTITSTTSTPTDTSPVPTPFQPDPHPHPHPHPTTQHYLPPPSSQTTPPFTLLTDLHTHLTHTPQHRASHLRNLASEISNTMYFVNSHTISGDFSAEDAAPVDRVMRIVREGELKMRYQERYERQKGKLVKRERRVAEREDRVSKREEMVSRREMGVAGWWEVWRERGREVWEGVEGEMMGTMEGNGYRRNGMDTLQRTVRVTREVVRRMDRIVDEGEVDGDGDVEGGVEVRGAYKIDYNCDDDIVGSTSYRIEICNPPQRSSAS

SEQ ID NO: 207 - protein, 1335 aa, Artificial Sequence
  Transgucosidase CAK40060.1
MSSTPDDKPQRATAAQLANRKIKEVRRRRPNSAAPSAPAPSFGGGPFASIDPNTVSSTPASSQTASNGFTFGQSQNQSFPGASSAPSQNGGTPFAFGSGGGGSSSSSFNFSSSFGGTSSASNPFASMNTTTSDQSSKPASFSGFQGSLFNIPPGGNQSPAQQPLPSGSIFGTSSQSNASTGGLFGASTNNGPSASGAATPASGSIFGQNNAAAAASTPSTNLFGQSSVKKPSPFGQSSAFSGDDSMQTSPDAKGSGSQQKPSIFSSAPPAQPSFAGAGSTSLFGASASSAAETPSKPVFDFKATTPSTSLFGGAATPTPSASTPAPAAVTTAAPASSSLFGAASPAKPSTPFQNPFQSSNLFQTTPSTSQKPDEEKKEEPKPADSQPKSPFQFSASTTTPGSLFAKSDAPASPAPAAPSTGLFQTSSTKNLFEPKPPATADAEQTKAPANPFGGLFAKPATPSKPAGEQQPLPSSSTPFQGLFSKPSTSNDAAKTSEPEKQATPGPMSFAPSSGGFSQTSNLFSPKPAASPAPAAETQATAASTSAAPVDSPIKVNGANSSPSVFTNGNTAPSTFGQMQTPKLAGKTTDPKTSEDAEMLYRMRTLNECFQRELAKLDPSSQNFDAAVQFYMRVRATLGASVGSKRKASGEAEDAVATKKARPFGIPSEKADTPKENSTTPAVSAQSSTPFKGFGTSQASPASSKRKSIDEGDDNSPAKRVNGDSSTANIFAQSFSKSKTEAEKPEPSVVKPSTPESTKPALFSTTPTTAPAKPLFSLSDSASKGSASTSLFSSSMSSATSTSAASGGNAPKNPFVLKPTSSEGSSTGSAGGTDFFAQFKARSFEDAEKEKEKRKAEDFDSEEEDEAEWERRDAEEQRKKQEQFGTQTQKRAKFVPGKGFVFEDESNESPAKKAEDSSSTTPGAGTIFSSQNNTAVKSNNIFGHLSATPSEAEDNDNDADDTEEASTPGDESDDAAENAVAADKKAESADSSAKEPEAGGRSLFDRVQYGEDGKPKRQGEEEPKGNVSTLFGSSNFSSSFNTPTSLTPASSGESNLAAPKPATTNLFGAPSTTSSIFGTPLSGSGNSTPSIFNAAQNATKSTGDNTWKPDSPIKFASDSASASSSKPDSGSATPALEAPKPFSNLFGAPPSLTKSSTSKDAQPSLGFTFGTPGQSSPSVFAPSTLTSAAPSRSTTPGGASDTGAEESGDGDGAESLPQLDLTRGGAGEENEDLVAESRARAMKHTTGTGWESQGVGFLRVLKDRTTSRGRIVVRADPSGKVILNTRLMKEIRYSVAKNSVQFLVPQSEGPPQMWALRVKTNADAERLCKSMEETKN

SEQ ID NO: 208 - protein, 957 aa, Artificial Sequence
  Transgucosidase CAK40395.1
MSNRWTLLLSLVILLGCLVIPGVTVKHENFKTCSQSGFCKRNRAFADDAAAQGSSWASPYELDSSSIQFKDGQLHGTILKSVSPNEKVKLPLVVSFLESGAARVVVDEEKRMNGDIQLRHDSKARKERYNEAEKWVLVGGLELSKTATLRPETESGFTRVLYGPDNQFEAVIRHAPFSADFKRDGQTHVQLNNKGYLNMEHWRPKVEVEGEGEQQTQEDESTWWDESFGGNTDTKPRGPESVGLDITFPGYKHVFGIPEHADSLSLKETRGGEGNHEEPYRMYNADVFEYELSSPMTLYGAIPFMQAHRKDSTVGVFWLNAAETWVDIVKSTSSPNPLALGVGATTDTQSHWFSESGQLDVFVFLGPTPQEISKTYGELTGYTQLPQHFAIAYHQCRWNYITDEDVKEVDRNFDKYQIPYDVIWLDIEYTDDRKYFTWDPLSFPDPISMEEQLDESERKLVVIIDPHIKNQDKYSIVQEMKSKDLATKNKDGEIYDGWCWPGSSHWIDTFNPAAIKWWVSLFKFDKFKGTLSNVFIWNDMNEPSVFNGPETTMPKDNLHHGNWEHRDIHNVHGITLVNATYDALLERKKGEIRRPFILTRSYYAGAQRMSAMWTGDNQATWEHLAASIPMVLNNGIAGFPFAGADVGGFFQNPSKELLTRWYQAGIWYPFFRAHAHIDTRRREPYLIAEPHRSIISQAIRLRYQLLPAWYTAFHEASVNGMPIVRPQYYAHPWDEAGFAIDDQLYLGSTGLLAKPVVSEEATTADIYLADDEKYYDYFDYTVYQGAGKRHTVPAPMETVPLLMQGGHVIPRKDRPRRSSALMRWDPYTLVVVLDKNGQADGSLYVDDGETFDYERGAYIHRRFRFQESALVSEDVGTKGPKTAEYLKTMANVRVERVVVVDPPKEWQGKTSVTVIEDGASAASTASMQYHSQPDGKAAYAVVKNPNVGIGKTWRIEF

SEQ ID NO: 209 - protein, 682 aa, Artificial Sequence
  Transgucosidase CAK96888.1
MPLRPPASPLSLETISPSPPDLDSDPLIASDDDLDDDDRAARDQRIEKLAQAYCHGTPLFILSASLRGPFENGWANPWKKDRRTTGGGHVGIHSEHSERPIIPETIPQKRPLYRESLGISRSKSAVPLSDPTYSSKKRESQGGTAGEPSSKRPRDSRGRTSSSNNTPKPIALHKRTIETSGHSDALTPFQHTEQSWLKRDRAEINFRKVDPPTSPTTTVSSRHREGGHYTIQVPGTDYRVTTKNILRARTDSRDGTTFDSHVPDSVKAQLTSRHPGVRPETEDHENSICVLSSTSHLSKFEFRRRKRSADPEHGTTSPVPMQLENEQVSHQTTVVEDSRVSSQPAPVPPNTTSMQAIEVDMQVNEDNSHHPNVSERSGTVDHQGNSQSRKVSSTTTAEGVNISDKYPSAQRVSVNPALAENVTSLQTISAVKPNSECDNDTIPDLHFNTQAALLHAQKSFQNDLESQVPNPGETHNQPSSPANDITPFHRMNTSRIGKYSRAIHPGTAHMPMSTQCIIDAVTPFTFSTEKKARSRFISPQMPSSSRIDRGTATPNTGSPLSSESEDEDEDEDPTILPHKSPAAQQQTPDDTQEGSALPMALSHSHPTTVQDGQGVAPGPDSFNLSQAIADAGSWLQQSFDINHEIQQCRSSAKSRPSSSAGISRSASGTILGHSTLDSVLLC

SEQ ID NO: 210 - protein, 830 aa, Artificial Sequence
  Transgucosidase CAK45960.1
MPGHSRSRDRLSPSSELDDADPVYSPSVYQREHYYNNDSLFDSADDDYTRTPRNVYSYETHDEYHDDDDDDDDVHEHDHDHEYDDKFEEPWVPLRAQVEGDQWREGFETAIPKEEDVTQAKEYQYQMSGALGDDGPPPLPSDALGRGKGKKRLDRETRRQRRKERLAAFFKHKNGSASAGLVSGDALAKLLGSQDGDEDCLSHLGTERADSMSQKNLEGGRQRKLPVLSEEPMMLRPFPAVAPTGQTQGRVVSGAQLEEGGPGMEMRHRGGGGPPAEGLLQKEGDWDGSTKGSSTSARPSFWKRYHKTFIFFAILIVLAAIAIPVGIIEARRLHGTSGGDNSSNSNLKGISRDSIPAYARGTYLDPFTWYDTTDFNVTFTNATVGGLSIMGLNSTWNDSAQANENVPPLNEKFPYGSQPIRGVNLGGWLSIEPFIVPSLFDTYTSSEGIIDEWTLSEKLGDSAASVIEKHYATFITEQDFADIRDAGLDHVRIQFSYWAIKTYDGDPYVPKIAWRYLLRAIEYCRKYGLRVNLDPHGIPGSQNGWNHSGRQGTIGWLNGTDGELNRQRSLEMHDQLSQFFAQDRYKNVVTIYGLVNEPLMLSLPVEKVLNWTTEATNLVQKNGIKAWVTVHDGFLNLDKWDKMLKTRPSNMMLDTHQYTVFNTGEIVLNHTRRVELICESWYSMIQQINITSTGWGPTICGEWSQADTDCAQYVNNVGRGTRWEGTFSLTDSTQYCPTASEGTCSCTQANAVPGVYSEGYKTFLQTYAEAQMSAFESAMGWFYWTWATESAAQWSYRTAWKNGYMPKKAYSPSFKCGDTIPSFGNLPEYY

SEQ ID NO: 211 - protein, 336 aa, Artificial Sequence
  Transgucosidase CAK40856.1
STSYGGTRTPDSSSTDVSRPSDLRTGPATRAGSGLTPSLDPSSRPLASRPANRDRIPPPPPKSHHGKRIAPSPGVTPSLTQTTPGKATNRFSFHGSPSEPSYSPRPPQSGSDYFSAKPKDEPPSTEQSTESLRRSQSQHKRPPTPPLSRRHSQMRRSKTTMSKVNPLRLSIHVAQASSAASSSSSPPPSPSGWSLNPARTRESRTGSTPSEEPMHTATSTLRPEPSAAAPVSPTETSQSTSTGSSTKRTSLYNPLPPPPPPRRSRGSSNHSIDSSGQSLRSGKPADETTAAPAAPAAQDEFVPHPSNAHDILADLSRLQKEVDDLRGHYESRKASQ

SEQ ID NO: 212 - protein, 179 aa, Artificial Sequence
  Transgucosidase CAK40944.1
MYISKVLLVTCAAFAPFASAAVQAKPTDTPVPVSSTHVASSPLAPTPTPVSPSPLHTASSSVIISSSSSSVRFHPSSSASPSHMASSSRRISSSAISSSAIASSSASFTRSYITKASARPTTTTSTDADSKSNSNSGSDSESATAAAASATHSGAAAPAVQLSGGMAAGVLAAAGFIML

SEQ ID NO: 213 - protein, 474 aa, Artificial Sequence
  Transgucosidase CAK41060.1
MPRSTVDQTSSAEAPYSGPRKLVLCLDGTGNQFMGFERDSNIVKIYQMLEKNTPGQFHYYQPGIGTYVEGQSSSSGLLRYPRKLQSNIITTIDQGVGTTFESHVLAAYRFIMRYYSPGDHIYIFGFSRGAYTARFLAEMIHELGLLSQGNEEMIHFAWETFSNFQQARGKTDRTAKDEALISYMKKFNTTFCRPQVQIHFLGLFDCVNSVGQFEIPFHRKSHQYLVSPAARHIRHAVSIHERRLKFKPALVLLDKTKPVDLKEVWFAGNHGDVGGGWSLAPGQFHLLSDTPLNWMLQEVLHLENSESKLSFHTLNVADVVERENAFPGKEEPGTTAYDVRKRTNQPHDMLMFNRGATFLMVIFWWILEILPLFTRLELEHGKWVPRQWPPNMGAPRDIPEDAVIHQSVHEMVRAGILDPKSIPPRGGNNSHLPSTARITGAWKAMRKNQEKQISSLLQKKPAGALRKEFDGKAD

SEQ ID NO: 214 - protein, 694 aa, Artificial Sequence
  Transgucosidase CAK41144.1
MDPANEYCGLEDYGLVGDMHTCALVSKNGSVDSMCWPVFDSPSIFCRILDKEKGGHFSITPDRRLKNPLSKQRYRPYTNMLETRWIHEEGVMNILDYFPIAKPKPHVACRSGMVRKAECVRGEMEIEIELFPAFNYARDSHVAQQSSASDDAIQVYHFQAESQNLVVSVLGDRGDISGDDSDLSIEFELSDRPGHLGPGLVGKVTLKEGQSITMLLHDQESITCNVEDLAPYLQQIERTTGDFWSDWTSKCTFRGHYREQVERSLLVLKLLTYKPTGAIVAAPTFSLPEHIGGSRNWDYRYSWVRDAAFTVYVFLKNGYPEEAESYINFIFERIFPPMDKNPKPGEPFLPIMITIHGEREIPEMELEHLEGYRGSRPVRIGNGAATHIQLDIYGELMDSIYLYNKHAADISYDQWRAIRRMIDFVIQIRHQPDQSIWEVRGPPQNFVYSKIMLWVALDRGLRLAEKRSNLPCPDRARWMHERDALYDEIMTKGYNSEKGFFCMSYENQDAMDAAVLIAPLVFFVAPNDPRLLSTIQKITEVPAKGGLSVANMVSRYDTGKVDDGVGGNEGAFLMVTFWLVEAMMRQLRKTATSQFDSILSFANHLGMFSEEVATSGEQIGNMPQAFSHLACQYMFNVIVKRKSLETCEYHIALDVEKRILQICYNEDISIFNKWLSISGFTYRQSFTISQLVVV

SEQ ID NO: 215 - protein, 946 aa, Artificial Sequence
  Transgucosidase CAK46428.1
MPIKLPKGFARRKSSSNALEEVQNPTQSSFRVFERPTGDKKSFSDGNLVAKRLSEGQPLDSPSEDDNNIFALHNSQPARHQYEPPLSPDEYLTPFAHPDGPQPESQSPHTRNLYDIPIPPLSGAIRAAGRTFSFGGRFSKASAPTPPPQPSTPGPSRSRGMTTSTSSTATPPKLPDTELRIGKIDDDFQNMFGDIGKRYYGSKDASLDQPVDLDSSGPSSRPDALPRKDERVSRPTPIDTDRSREVEPSPYSWDSRHSEEGLLTTLDSPNEQPATQPYQRNIDPVSVGDRRKSIPLPGTTPLATTSHRSLAKPRTTADKGLRRSGVYSNRRDSVPVEDEDAKLIMESLYSKRSSQVPFMADHGASDAENDGPLFDQPGANSSHPDRRESIQKDSLSSPVLSDHLDPSIAAHARLAAQYEKAQPVTVSSTNKVMTPSQFEHYRQQQELRRSNSDASKSENSAESDYDDDDEVEKDREAERQRRKQEAHLSVYRQQMMKVTGQESPAPAMRTELDQASKSAPNLLQPGTTLGSGKSSDGDDDEEIPLGILAAHGFPNRNRPPSRLAPSSSIPNLRASFQQPYLSSPSPASVAERDPNNRGSLPVFARNLPRDPYFGASLVNQSNRESLALGGGASVHGGPSPALPPGGLVGVIATEERARAMRRGSPNTQAMYDYQGGMPVPPVHPRGIPRPYTMMSLSSPNAGGVQPTISATEQAQIELSQQMTQMVQMQMQWMQQMIHMQGGQSTQLMPPGGPPPTLGANLNARPSSMPSAGNMNNPHAGYSGDQRTLSMLDPNVSSRLNSAAMPHVSGGLRPSTPAGQGYAPSIAPSERSNVGLAPRYRPVSTIQPDLGNVGSPSIPKSWSDENRKSSLSAAVPAAPQASQMSHRPMPSNSKPIRASKLNVGADQDDEDDDEGWAEMMKKRENKRNNWKMKKETSSFGDLLNAVH

SEQ ID NO: 216 - protein, 1250 aa, Artificial Sequence
  Transgucosidase CAK41498.1
MYGSQSGHQSSAPPQPEWRLPSSTQQPASSRHHPPQPSWRASSPPPPPPPPRPTTTTTSSSSPFNPTVYGQISNPPSTVNNYPGTSVSPVSAVAGSETTSWGVKYNRHQLHAQSPPPLPPRPSSTAQSPQAQSPVVSPLDPNKPLPAAPGWATQSADNTSYQQWPSNPPYAPQQSVSASSLQPPPPPPAISTGYQSSSAQQSNPWQQPPAVPPPPYSGVPLGQYQDSSVQQPATLPSNQQITGHNAPNPAIPQAPSPKPSTGLHYESQPLPGPPQAPVAATLSPTHGTPPVVPPPVPPKTSPITVPTSASVLATGGPSDWEHLSPIPGSIDDLGAFGSRPQDGSSSEPLSQASQSRPPNIGEPVRKDESVSPITPPNNAPQMTSQTEGPLASQTVVRGNPHQPVRMGSTGSVSSDISTSETPESIDGIIEAWNRPISSQPSAEQNPQSSASGVRAGILPPSRKQSPIGTPTPRQESIIPRKQVRSGSSSVESSSVTNGPTTDKRTILPAFVPLDPYDDLDPWSKSSLERYVAMLRKEAVADSDAERYNIFTAFMAKETKLREILFNIEPESTRVGENPKVSSRQPTPILRASTSVSNDDTESGLIPVETEGGHVVSTTDDADSEDGSYSPGGRPILPRIQTPGATKLQRSASHTVSNKYNTDHVAHATSSRATSVPPSMLGDARHEHALPPLTTNPPQPIYIPFRYTEGPQRGSDVLVFDRPAYQAYSDLRQASAESGRVMSNAPAPTPGERPDSAVPSRRNEHDETFIGLIREKSVAYRKRAPRKTSSPPPLPAALRHGKPASPVDDLRSMASSPLSKQSESSWNMTTRKDLENYSSDFSYIREAVKSWEISSKSRREQLDKERIHRQEVSEKRIDALFNGKEIGYADINLLEEEFRQKEARAQLDEERQELDKFVAEVFEPLDQRLKEEIAALQALYEAALAQLDHENGRTKSATTDRYNLSHTMRTVNEIYRKLELRYQKRLEIALDRERRRKKAERRPLVFMGDSVALKGVDQEFDQMEKRNILEAARERDHRANRLMDSFDDAIMHGLGENQSLLDEVAAKVAKVDTATIRSSGLPESEVEQLLKSVYNLIESLRKDSESILHNFNMADSVLNDADYSVSVAEARYSDADADVFRRLDDEKRKEDTKIQTDLKTKLESIRSGPANIVTSINGLLESLGKPPIIDQTGPSSQMPADTPASVSQHLPAEIAPQKPQEDPEHQERLRKALENAKRRNAARVNTEISRP

SEQ ID NO: 217 - protein, 610 aa, Artificial Sequence
  Transgucosidase CAK41767.1
MCNKSNYSSPKWWKESVVYQVYPASFNCGKSTTNTNGWGDVTGIIEKVPYLESLGVDISQTSREQCLTSLSLVYTSPQVDMGYDIADYESIDPRYGTLADVDLLIKTLKDHDMKLMMDLVVNHTSDQHSWFVESANSKDSPKRDWYIWRPAKGFDEAGNPVPPNNWAQILGDTLSAWTWHAETQEFYLTLHTSAQAELNWENPDVVTAVYDVMEFWLRRGICGFRMDVINFISKDQSFPDAPIIDPASKYQPGEQFYTNGPRFHEFMHGIYDNVLSKYDTITVGETPYVTDMKEIIKTVGSTAKELNMAFNFDHMEIEDIKTKGESKWSLRDWKLTELKGILSGWQKRMREWDGWNAIFLECHDQARSVSRYTNDSDEFRDRGAKLLALLETTLGGTIFLYQGQEIGMRNFPVEWDPDTEYKDIESVNFWKKSKELHPVGSEGLAQARTLLQKKARDHARTPMQWSADPHAGFTVPDATPWMRVNDDYGTVNVEAQMSFPWEMKGELSVWQYWQQALQRRKLHKGAFVYGDFEDLDYHNELVFAYSRTSADGKETWLVAMNWTTDAVEWTVPSGIHVTRWVSSTLQTAPLMAGQSTVTLRALEGVVGCCS

SEQ ID NO: 218 - protein, 966 aa, Artificial Sequence
  Transgucosidase CAK41979.1
MPLFNAKTLLAGLCAASIVSPSLGLPQSSHPGSSAVANTQGRASSESHPSWTLESDSTAATVSTSNTPLYSPSSSATASLGATQGSLTDDHDGASKSSTRSYGVTTISYSSAPVNNPQSAHDASASPSTPSGPHSHTTTLSSSSAGVPAQSQTTSSSRSHSVVSKETSTRSPSSLFTPSASTETPTNPSHTPSTYTISTHSFSSSEHASSESATSFHAVSTSKHTHTHTPTSSTSSSNTPTRSSALTQHETSTSSSTPTRSHTHTASTPASSKANTSSSIKTHTTHSHTEDTTSSSASHTPTSSKSSSSSAEDVSSSPASHSPTPSTHSITTTTNTDTSQSASITSGPSTTPNSTITTTSSTTTSSVDVYAIIKHLYKLVKDTYPVIKKWKEDPKSVKASDLIKPLKRVIPVADDVLDVLGAPSSLSSSSGDSESVLDSCSSGGGLLGDLIGIASCISSTADEAVSILGSSSDSDSSDESTLSSYFDAFETEGSSLSAVGVTATGSTASSTGTTTTTSSGDTSSKSTKTATSTNTDSDTSTQSTKTKTSTKSTTTSDSSSSAGSGGHSASASASPTSTKSSTSTKESSTSTKTKTKSNTESSSKAASSSAAASKTDSSSSSAKSTSTDSTSTKKTTSTKSTATSSSAPLSASSSAHTSSIATTNTTSTSTNSKSSTSTDTTTIIIHTHSGTASGTTTHHTSTVTPSPSRNQTATTLVTTTSSYTPPLCYNHADPDNGAGNVCICTRSNGDYTTLSELPSGSGCSYTSIPTPTTTSTTKTTSTKTTSDPPFTVTELNSDVIVCATSTLSYFSTFTYTQCAGSSSTIYTAPTPTPTAQVVIAYLSDVYSFWSFFTPDIGSSIDFCNDAEAGELEASGSIKVIDPPYPDGTKELDFEIHDMKDCVYKGTSDEPGTFTCPDLAKTVDCESYGENKVHDCYGALSDGGVVYEEGIDCASIGSVEVQAENGI

SEQ ID NO: 219 - protein, 822 aa, Artificial Sequence
  Transgucosidase CAL00956.1
MHLSKISAILTPVLNAAAVLSSQAPADDLSVLSSEVARANNQSLLWGPYKPNLYFGVRPRIPNSLFAGLMWAKVDNYATAQQNFRHTCEQNEGMAGYGWDEYDIRKGGRQTIHDAGNSLDLTIDFVKVPGGQHGGSWAARVKGVPRGDADPDQPTSVLFYAGLEGLGNLGVEGEPEDPRGFTGDVKLGGFTTDLGDFSIDVTSGPESNEYPEHGHPTYDEKPLDRTLVSSLTMHPEQLWQTKVIMFTQMKKEVDEMVEKYGSENPPPPYQLFTIKNEPGDGNMHLVQKVFKGSFEFDILFSSASSPQPMTSELLTEQISSASLEFSERFESVHPPQAPFDTAEYTEFSKSMLSNLVGGIGFFHGTDIVDRSAAPEYDEENEGFWEETAEARGRAQPILEGPKDLFTCVPSRPFFPRGFLWDEGFHLIPVIDWDTDLALEIVKSWLSLMDEDGWIAREQILGSEARSKVPPEFTIQYPHYANPPTLFIILEAFIDKLDAKKNASMQTYADSGVTGNLRSIFVDQPELGEAFIRSIYPLLKKHYYWYRSTQKGDIKSYDREAYSTREAYRWRGRSIQHILTSGLDDYPRPQPPHPGELHVDLMSWMGMMTRALRRIAVTIGETEDAEVFKTYETAIERNIDDLHWDDDARTYCDATIDEYEEHVHVCHKGYISIFPFLTGMLGPDSPRLKAILDLIGDPEELWSDYGIRSLSKKDQFYGTAENYWRSPIWVNINYLVLKNLYDIAIVSGPHKEQARELYSNLRKNLVENVFQEWKKTGFAWEQYNPETGSGQRTQHFTGWTSMVVKMMSMPDLPASEQKGHDEL

SEQ ID NO: 220 - protein, 1027 aa, Artificial Sequence
  Transgucosidase CAL00976.1
MEVMDMPKRNSPVSQPTAVAMASTSPHPEKKASDAPYIVDDDFPGDDDDDDDVSISPISERAPPWSGTRWARFFPELSSHFSLASPTNSTNPPFPQPLTKGPPHIDGPSQQPERRSKGPSSLSSEDVADNRSSSYTSRSSLTSQGSEATSPVHKLVDSLHIKSPTKAGVFDESKFAHQIPPPFPSRSSIAQSKDKPLPQEPPIELTPLSIRHKTPQIPDRPGYLSRLDPPPRSKKHASHHHPTLSQACTDLERTLAGLAEQQHSPAQLSPRSPLQILDGPLQISRGNMDMVATRPAPRPPASVHDNRQIHKAKSREDMKQTKKLLKNKPSFSFTVPAFGRKLSRVHHRSTSNTSSKSEPESYRASVLHQPAVAELGDSEVAELQGSSVIGFRERPSSAGGEKELRMRLPRLQTKEMGAPGRKRDNIHSTHEGPEQLRRPNGRARGASVGEKYFVSYSKLDGMPVHSTRQHQPTSQTSCMVYELEGGSTQPPAELQGDTTSPIDVVPVRISVGVSSVGAMPGTLPDRVILTVLEHITSLDDLFNVAVSRKDFYRVFKMHELKLIRIAVFAMSAPAWELREMSPPWDTEWHFVLDPDAPVPEYTPSCYLKRYAEDIYTLAHLKSLILARCGTFLRPETIRGLSGTDDIRAAEVDDAFWRVWTFCRLFGSGKGREGDIAGQLDWLRGGEVARNRRVSEFTSIADPYDANSVLFEPPTGFGDGNNGGLSKEQLLDMTEIWTCLGVLLQPMHEEWAYYILTLGLSAVLVLGSIHPYDNTTAVFQRAHSMGLTNWEASDTGASRSSFLREAVSKACQPRGSSTSQASMRSSGFSSQPSGSHDVSQTSNVRGEREPSPDFHRRRQAAYSAQLRIQRQQQPSPPNPMLAEERPISHYATIMSRLEGLPPAPQPPMSVSRIEIPPTTHSYMTNVSYMQPLQSVTPVYYPPQVRDPVDHAIDIMVRELGFGEEDAKWALKITDSGEGINVNAAISLLTRERKTHEQSSRGFSLRKRKSFLSSVINSPESRHSGWKWA

SEQ ID NO: 221 - protein, 893 aa, Artificial Sequence
  Transgucosidase CAK42352.1
MEPLRRSQSSRSMRRSHHSSQSTEPFDPELARFQATTAASRAMLRSKCSYDVLGGPSKMAVPQRQHRPAGAALNATNAPVEDVDLRRSVLDKTSDLSPPAGLPSIREFGRLDAGIATLPSSYRRLRKTRSMFTNWQRSSHVPRGLSSPGCPTHNILTRREPQDVLRAPGTLRRSMSFFRGDTQNSDSLRYARGQDVAIEMARSHYQQPEIYPTELRKSSLTVPKSRPFKKTLRSVVSDAESASVSPAIQRSTNVISYGKARSLSSSLKKGLKKVLELSRPSSARISLGKSSSNDQQRIQGSPSTISAKHSDPLNSGVEGNALTHSPDTEGTVVYTGVKKSESSESLATSRSRVTSWADSTIANTVITYRADDHSSLSVIDEHDSSCLKPSSSEDVSLTTCRTPKPNCTIDSQRLYSALMKRIDGNKTENASKEIVLGHVREHRAIPTPVSSMYTRRSRKTIRLIASDESLQSPGSYTTADVGTVTPCEPAQRQAQRTHGQKHLQDIRFGSANLASSKHTIKEDSRDETGNMAMGRSQSPEEDEDSPSMYSRSTGGTSPKTTDPKMGESDPEVANEPGVATIYASQRAIYSSPKRNADQGPEAMQRPSADWQQWVRTQMERIEYLTPTRRHYREDAQIQDETADLAYRTPSRDRRGFWSGSPDEDLRTTCKVTARNNFSRPFSRSSSVRTTVIAPKEQADTLVPPPPPSDSTPKVLSSSSGRSLFINQVETRPDGMALSPVPALLNNRYRAPESPTPRRDATDKARWRAGGRRYGRQPSRLLPEAQDSKASQIRSSRVPQENRRLTDENVRLENGYQEVASKDSQLQNMYSPISSKRMVEMFLESRRRRMGTEMSDGAPSKDDGTKLSSDSVYDRHHIESLFYSLAPMYETPTN

SEQ ID NO: 222 - protein, 542 aa, Artificial Sequence
  Transgucosidase CAK42453.1
MANIIWLALVLVALSIHVQAKDVFAHFILANAENFTQTHWTRDISAAKAAQIDAFALNTGYGAANTDQLLTDAFTVAAAHDFKLFLSLDYSGDGHWPPDQVLKVLQGYANHTAYYRVDNKHPLVSTFEGYEALADWSTIKEKLPNIYFMPEWSVRTPQELASEDAVDGLLSWSAWPYGTTPMNTSTDEQYISALKAKDKPYIMPVSPWFYTDMVRYHKNWVWQGDGLWHTRWKQVLDLQPQFVEILTWNDFGESHYIGPLHENELGIFSFGQAPFNYASGMVHDAWREFLPYVVGEYKNGSGKGVIDKEGVVVWYRVTPAWACKAGLTTGNSVTQGQQTMPPGQVLKDEVFFQALLEDTADVEVSIGGGENKSVGWTDTPSGGSSGGGRGLYFGSVPMDNRTGEVVVTLSRNGKFVAQMIGEKITTQCPDKLTNWNAWVGTAMSNVSNASTSRASLSEENGAASVRVGGGRGMDMWMGALWMVVVVGIRADRSIPTKWACGSQINEEVLIQRRERLPLVEGDRVYLDSSSKAFRRRRRTCTR

SEQ ID NO: 223 - protein, 819 aa, Artificial Sequence
  Transgucosidase CAK42457.1
MKVPADHALLLSSLLLAPSVGASTCQEPINHPGEPFSFVQPLNTSILTPYGGSPPVFPSPETKGKGGWEKAMAQAKNWVSQLTVEEKAWMATGQPGPCVGNILPIPRLNFTGLCLQNGPQCIQQGDYSSVFVSGVSAAASWDRKLLYDRGYAMATEHKGKGTHVVLGPIGGPLGRSPYDGRTWEGFAADPYLTGVCMEETILGIQDAGVQANAKHFIANEQETQRNPTYAPDANATTYIQDSVSSNLDDRTLHEIYMWPFANAARARVASFMCSYNRVNGSHSCQNSYLLNHLLKTELGFQGYVMSDWGATHSGVASAESGMDMTMPGGFTVYGELWTEGSYFGKNLTEAINNGTITTDRIDDMIVRIMTPYFWLGQDKNYPSVDASVGPLNVDSPPDTWLYDWKFTGPSNRDVRGNNSAMIREHGAASTVLLKNERNALPLRKPRNIVIVGNDAGSDTQGPSTQTDFEYGVLANAGGSGTCRFSYLSTPQDAITTRARQYGGRVQTWLNNTLITEKSMPELWNPEQPDVCLVFLKSWSEENVDRTYLTLDWNGNAVVEAVAKYCNNTVVVTHSAGVNVLPFADHPNVTAILAAHYPGEEAGNAIADLLYGDANPSAKLPYVIAYNESDYNAPLTTAVATNGTYDWQSWFDEELEVGYRYFDAHNIPVRYEFGFGLSYTTYNLTKLVAAKPVASNLTALPEQRAVQPGGNPALWDTVYTLTAQVSNTGSVDGYAIPQLYVGFPDTAPAGTPPSQLRGFDKIWLEAGETKKVTFELMRRDVSYWDVTAQDWRIPAGEFTFKAGFSSRDFHANATATFFRK

SEQ ID NO: 224 - protein, 358 aa, Artificial Sequence
  Transgucosidase CAK42741.1
MHLRRIFVLTVLSYVTALPSDINLGVALRGCDVEACDMECRMAGSIGGNCGGNPALNLLGLPLLSTNTPNSSSAGPVTLAATETLTDVESTTTTKTTTDRESVTATETTTDIESTTATQTVTDTHLLTVTKSITEKQPTTATQTATDTKFLRTTQTINNTLTATQTTTDIESLRVTKTKNNTITATQTTTDIEPTTATQTINNTLTATQTTTDTESYTAMEITTATASFTTTQTTTDTESITATQNITDTQTIHHTESLTATRTITDTDSVTATATPTTVTDTQTSISTTTATQTATPTPEVGACFCCTEQVRLPYELNGNCDNIPVSNSTDGCPSGDDPKRNHLLCCDSSGYCTQLS

SEQ ID NO: 225 - protein, 648 aa, Artificial Sequence
  Transgucosidase CAK46804.1
MGSYTFTWPYNANEVFVTGTFDDWGKTVKLDRVGDVFEKEVPLPVTDEKVHYKFVVDGIWTTDNRAPEEDDGSSNINNVLYPDQILKDSTTPLLNGTAAMAGVTPGSTTAALAAGVPKESSSKHGQNGYYPTISSAAPGSTTAALGQDVPLEQRANVPGSFPVTPASEADKFSVNPIPASSGAGNPIKLNPGEKVPDSSTFNTNTISSTARTDRAGYEQGTSGGFPGSPAYDASAFAIPPVSKNMIPESSLPMGENQGATEPTYTIQSAAPTSTTAGLAAAVPLESQRQTSSGAPTRDVPDVVRQSMSEAHRDPEAATNKEAVDEKKEMEEELRRKVPVDNSTGAPAPTTVAGLGTSSGLGFTAGAAPSTNLGPSTGLDVATGMGTTTGLDSVSGPTAAQSFQKETTSGLPAHDVPDVVKQSISEAHKDPEAAGVEEAVGEKREVEEELQQKVPVSNQSGTPAPVITAATSETAPGSGAEPASERAPRATGGGPASAQISPRATTPTDGPTVTTGVATSKAPEESGPGASGREETTEIPTKPAAGATGASATKTVDSGVESGIAPEDTTSAPTAGATGASATKTADPTETSGAPTSGASKPAESAPTNNAAATSKPATNNAAGAATNGKEEKKKKGFFSRLKEKLKSV

SEQ ID NO: 226 - protein, 818 aa, Artificial Sequence
  Transgucosidase CAK97412.1
MARVDFWHTASIPRLNIPALRMSDGPNGVRGTRFFNGIPAACFPCATALGATWDAHLLHEVGQLMGDESIAKGSHIVLGPTINIQRSPLGGRGFESFAEDGVLSGILAGNYCKGLQEKGVAATLKHFVCNDQEHERLAVSSIVTMRALREIYLLPFQLAMRICPTACVMTAYNKVNGTHVSENKELITDILRKEWNWDGLVMSDWFGTYTTSDAINAGLDLEMPGKTRWRGSALAHAVSSNKVAEFVLDDRVRNILNLVNWVEPLGIPEHAPEKALNRPQDRDLLRRAAAESVVLMKNEDNILPLRKDKPILVIGPNAQIAAYCGGGSASLDPYYTVSPFEGVTAKATSEVQFSQGVYSHKELPLLGPLLKTQDGKPGFTFRVYNEPPSHKDRTLVDELHLLRSSGFLMDYINPKIHSFTFFVDMEGYFTPTESGVYDFGVTVVGTGRLLIDNETVVDNTKNQRQGTAFFGNATVEERGSKHLNAGQTYKVVLEFGSAPTSDLDTRGIVVFGPGGFRFGAARQVSQEELISNAVSQASQASQVIIFAGLTSEWETEGNDREHMDLPPGTDEMISRVLDANPDNTVVCLQSGTPVTMPWVHKAKALVHAWFGGNECGNGIADVLFGDVNPSAKLPVTFPVRLQDNPSYLNFRSERGRVLYGEDVYVGYRYYEKTNVKPLYPFGHGLSYTTFSRSDLKITTSPEKSTLTDGEPITATVQVKNTGTVAGAEIVQLWVLPPKTEVNRPVRELKGFTKVFLQPGEEKQVEIVVEKKLATSWWDEQRGKWASEKGTYGVSVTGTGEEELSGEFGVERTRYWVGL

SEQ ID NO: 227 - protein, 774 aa, Artificial Sequence
  Transgucosidase CAK43189.1
MAVRRSARLRSRQATEPEAPADPVVTDNNAPCDTNNHNNSENTSEIDTTMARLGKQPERLPPVVEHEEPADAAKDVPVQRSRKKTKTETASKRRSKVEAKEPVAEVTPVIAESQSNTDTTEPAVAETEKKPTPKAVPEPAVAETEKNPTPKALPETASKLSTPKKSIPTLKGTPVHRNTPVHRSTPVHKSTPTRTPSSTLVRPSHQEMHPSKVRQSTTKQADSGLILGFKPIKKDAEGKVIKDTLADNTPTKAKASPAPYYGTPAFEFKFSCESQLSDEAKKLMETVREDAAKIKAQMTLEPDQNRAEAADRKIVQPKGKASRFSDVHMAEFKKMDSIAGHASAFRATPGRFQPVVKTLKRTNSKARLDESDRNSPSPSKIARPSPAIVAPASNKRVKHDKADDASTRRPTAASPPKPVQPRPRSTVRSSLMTPTRSSAARASSVTARPPRTSMIPSLVRSPAAKPADVPRTPQTEFNPRLKSNLPTLGNLKSILRRHQPLFSKDPSKIAAGTHVAAPDFTSNLLFGSRGTTEEPAQTPSPKKRVEFTPSVKARHEEVMFSPSPSKVPVASPSRTTSDVVYPTLPVLTPEQNRVSAKSPAQATTPTIRHVRPSDVHANPLPEVAGVPHGIGHKKRTRESGEDTKTNDLPEVAGVPHGIGQKKRNRAALEDETDTENVPPVDLTADARSAKRMKMTSPSPLKAPTLSARKVAAPSPTKAATPSPTKPRSHTPLRSATTSRMSTPGISTPASVRARNRGVLSVSRLNMLAQPKNRG

SEQ ID NO: 228 - protein, 757 aa, Artificial Sequence
  Transgucosidase CAK43257.1
MSLRWRKKTHWPPSPCVEDEVVSLSRELHGLSQIREMPGLEGVCSRGSVDQYPVLVDVFSYSSYEETTVIYEDFSRDSSSEDNVGPPTPVDEKQDPMLYLVGDDQAVSLSAPLATREQSQDPSKTPADNEQGSTTRGRPRADTRAQRDSPSKKDTAQSSRDASRASNIRTPAVTQSKSTPSLPRRFGSVKHGRSADALTTKSGYQSDSATVKSKAKPETVDKSAAPQTDKKSPTGLTVAERLEEKIRQRQELRAKESSGDAPKTPSPPSTDQPSVPVGRAAEPSITPAATAAPKSTAPKTRPRSTSTPKEPTNDHRVDGPEASSSAAAPALQLPPRPGLASKPAGRSVSSNDAKSTAQLPARRAVSFLDDVPQRSSSLPRTPEDIPEPPPLPRRRSSSQDAVRHRSSSQDAVRQTSPKRPFFLPPCPRSTPIAGYQDWHTVKGLPHLNICPSCMKQMRKSEFRDHFVLASPRSRGEKIRCSMSEPWTRLAWMQTLKKQLDHLELLHQITRPPLSIKPCPGRIITEQHWYRIVDPETNMYLPQFNVCSACVRNLRVLMPQHRDTFKRSSTKQERACDFLTDSPRFVRYIDYLDIAANRADQENMLRPDVTEFLSYARRKVVLRDCRRDRRILSTWHYMPQLPELTVCEDCYDDVVWPLVRAKQPIARKFSTSMRLLPGDGPSRCREASCQLYSPRMRAKFAEAVQSNDLMYLKQVALRRRDAEQRYRDREEELLEDASRGYDVEGEMRRNVEEWKRNE

SEQ ID NO: 229 - protein, 616 aa, Artificial Sequence
  Transgucosidase CAK97469.1
MSLLPVILVTFFLVFCCAAGPIAPFASKRDLESLSPSPSLTTPYVHVASSSVDDDDDNEINALTVVPVTPSSLPQTASSSSTTIEPALSSSAAFIQESSIVAATTSSLSESSSAVTHSFAPSTSSDSTVNTLSQTLTSTTTTTTTTSSPTTLGEPSSAPFSPLSSAVRSSHTTSSSSHIMHITTPSTTLSESSQIVTPSIIIPGGPMEASSSHAPGTATSSHITHETSSSAVRVSHSSSAAAEMSKSSPSHQGTLNSSSRLLHSSTAALLPSSTAPESAPETSSTRTSETTTSTSLTIGVIVPLPEASTSPSTMLEMSSSTSQSSESITTTADDTSSASSTKVLSTPTESETTTPTSHTASPFIGVTIPTTTKTTQPADPADITTTTTTPTSEAEDATTTSAPTPVVVLVTPEGSTTVIGTSSFIAPNPDITSTSTSTSSLTTTIEPTPTTSTTEPPTTLHATSTTIQTVYVVITDTPTPEPTWDSTTIATAIITVYDKSTSETVPTTTTTSRAGEEMESTTTTPLDTEQTSTQSTEDEIPTSTPIADTETATAIITSYPSTSTLSGETGDVIRIVPVTPTGPITVTVTVTEKERETVTKTETVTERVTETESVTT

SEQ ID NO: 230 - protein, 847 aa, Artificial Sequence
  Transgucosidase CAK97480.1
MPQKEFVPKTYQESSTGAQSSSSVHLRSSPEERSFDFSFEPIRENLFRVTFSSQDHPLPPYPSVTKPATSLDGVHVSATGGSNQKTIEVGDVTASVEWSNTPVVSLSWKGTEKPLYRDLPLRSYVADSTGIAHYTEHDRDCLHVGLGEKRAPMDLTGRHFQLSATDSFGYDVYNTDPLYKHIPLLIKASPDGCVAIFSTTHGRGTWSVGSEVDGLWGHFKVYRQDYGGLEQYLIVGKTLKDVVRSYAELVGLPILVPRWAYGYISGGYKYTMLDDPPAHEALMEFADKLEEHGIPCSAHQMSSGYSIAETEPKVRNVFTWNKYRFPNPEEWIAKYHGRGIRLLSNIKPFLLASHPDFQKLIDGNGFFKDPESSKPGYMRLWSAGGATGGDGCHIDFSSAVAFKWWYDGVQSLKRAGIDAMWNDNNEYTLPDDDWKLALDEPTVSDAVKKGVENSVGQWGRAMHTELMGKASHDALLNIEPNHRPFVLTRSATAGTMRYAASTWSGDNVTSWEGMKGANALSLSAGISLLQCCGHDIGGFEGPQPSPELLLRWIQLGIHSPRFAINCFKTSPGNSSVGDVIEPWMYPEITPLVRDTIKRRYEILPYIYSLGLESHLTASPPQRWVGWGYESDPEVWTKALKSGDEQFWFGDTIMVGGVYEPGVSVAKLYLPRKANDQFDFGYVNMNEPYNYLASGQWVEVPSEWRKSIPLLARIGGAIPVGKPVHTRVPGDDTPASVAVKEVDDYRGVEIFPPLGSSHGQVFSTTWFEDDGISLEARISEYTVTYSSTEEKVIVGFSRDEKSGFVPAWTDLDIILHNGDERRVVSDIGKTVEYKGKGSRGRVVYTLKN

SEQ ID NO: 231 - protein, 1324 aa, Artificial Sequence
  Transgucosidase CAK47332.1
MNEGRLAHPQFNQYSFKAGASTVQAEAAPALNYEDASTHNAAKNATKRSGRKGDQTYTYSIPPELAEAARLVAEASPQPVPTDYGVDISLVVSKYRKYDNNDTNVPKQKYVEPNGLDGYVHTGQPEDSPEIHTELKKRATTDFWLTQMGDSGSSPYAPDGYKVWRNVRDYGAKGDGITDDTAAINKAISDGGRCGAECGSSTIYPAFVYFPAGKYLVSSPIIQYYNTEFYGNPFDYPTILAASSFVGLGVITSDVYTGDDTEWYINQNNFLRSIRNFKMDITRTDPNAYVCAIHWQVAQGTSLENIEFYMMQDGLTTQQGIYMENGSGGFLTNLTFVGGNFGYVYAFSQRCTPLSDLPSGHTLATQFTSTSLTFMNCKTALQVHWDWAWTMQDVVVENCTNGIVIVGGAGGPKSTGQSVGSLILVDAVIAHTQTGIVTTLLAENSTSFLLQGVVFIEVDTAILDSAQGKTLMAGGSNVPVFSWGFGRVVTTGAESTFYNGQDIPRTNRSVPLTTIGYIEPNFYLRRRPTYRDIGMSQVINVKDWGAAGDGKTDDTAVLNSILDRAANMSSIVFFPYGVYIIRDTLRVPVNSRIMGQVWSQIMATGPKFQDEQNPHIAVQVGQVGDRGIVEIQSLMFTVSGPTAGAVLMEWNVHQVIQGSAGMWDSHFRVGGATGSQLQADECPKGSGVVLPACKAASLLLHLTSQSSAYLENIWLWVADHDLDLQDQAQIDVYSARGLLVESQGPTWLYGTASEHNVLYQYQVSQARDLYMGMIQTESPYFQNVPPAPSPFSPGLFPNDPTFSDCDSDSQTCPVSWALRIIDSTSVYSMGAGIYSWFSAYSQDCLDTESCQQHAVGISQSTNTWLYNLVTKGIAEMVTPTNEHPTLSADNVNGFMSSILAWVRLANTTIGARKFPGFQLYQPKWLDGLTDTCKTALSQKILCHPYLEMKFSNPGIGQYIDNNTLADEVCDQGCGESLQMWTTNVANSCLNQTIDDTDPVAAGGYIYAGYNLTCLRDPHTKKYCPDVLSHFTIVDSVRSMTLAEMCSYCFTTSLEMRQASPYAAYTDVDKDALETVNAECGLSGPTDLHKPLYTEDEVDRPICMSGITHTTSEGDTCDLLAYKYHVASAVIQLANPMLVNDCSELIPGRQLCMPLSCDTQYTLQDNDTCLSIEWAQPIGFGEVRRYNPWLNVDCTNLQTTRQVHGSVLCLSPQGGSHNVTGTGSPCPGISDGYTNVVQYAPTNSTIAKGTTCYCGKWYTVQQGDSCATICIKQGIPSSLFLAVNPSLSTSDCDTSLQVGYTYCVGPDTHWDDTDNFWGEFACEAY

SEQ ID NO: 232 - protein, 108 aa, Artificial Sequence
  Transgucosidase 1ACZ_A
  VARIANT 108: Xaa = Any Amino Acid
CTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWX

SEQ ID NO: 233 - protein, 957 aa, Artificial Sequence
  Transgucosidase ACF60497.1
MSNRWTLLLSLVILLGCLVIPGVTVKHENFKTCSQSGFCKRNRAFADDAAAQGSSWASPYELDSSSIQFKDGQLHGTILKSVSPNEKVKLPLVVSFLESGAARVVVDEEKRMNGDIQLRHDSKARKERYNEAEKWVLVGGLELSKTATLRPETESGFTRVLYGPDNQFEAVIRHAPFSADFKRDGQTHVQLNNKGYLNMEHWRPKVEVEGEGEQQTQEDESTWWDESFGGNTDTKPRGPESVGLDITFPGYKHVFGIPEHADSLSLKETRGGEGNHEEPYRMYNADVFEYELSSPMTLYGAIPFMQAHRKDSTVGVFWLNAAETWVDIVKSTSSPNPLALGVGATTDTQSHWFSESGQLDVFVFLGPTPQEISKTYGELTGYTQLPQHFAIAYHQCRWNYITDEDVKEVDRNFDKYQIPYDVIWLDIEYTDDRKYFTWDPLSFPDPISMEEQLDESERKLVVIIDPHIKNQDKYSIVQEMKSKDLATKNKDGEIYDGWCWPGSSHWIDTFNPAAIKWWVSLFKFDKFKGTLSNVFIWNDMNEPSVFNGPETTMPKDNLHHGNWEHRDIHNVHGITLVNATYDALLERKKGEIRRPFILTRSYYAGAQRMSAMWTGDNQATWEHLAASIPMVLNNGIAGFPFAGADVGGFFQNPSKELLTRWYQAGIWYPFFRAHAHIDTRRREPYLIAEPHRSIISQAIRLRYQLLPAWYTAFHEASVNGMPIVRPQYYAHPWDEAGFAIDDQLYLGSTGLLAKPVVSEEATTADIYLADDEKYYDYFDYTVYQGAGKRHTVPAPMETVPLLMQGGHVIPRKDRPRRSSALMRWDPYTLVVVLDKNGQADGSLYVDDGETFDYKRGAYIHRRFRFQESALVSEDVGTKGPKTAEYLKTMANVRVERVVVVDPPKEWQGKTSVTVIEDGASAASTASMQYHSQPDGKAAYAVVKNPNVGIGKTWRIEF

SEQ ID NO: 234 - protein, 640 aa, Artificial Sequence; identical to SEQ ID NO: 172
  Transgucosidase CAY05387.1

SEQ ID NO: 235 - protein, 639 aa, Artificial Sequence; identical to SEQ ID NO: 170
  Transgucosidase CAY05391.1

SEQ ID NO: 236 - protein, 108 aa, Artificial Sequence [sequence omitted]

SEQ ID NO: 237 - protein, 957 aa, Artificial Sequence; identical to SEQ ID NO: 208
  Transgucosidase CAS97680.1

SEQ ID NO: 238 - skipped

SEQ ID NO: 239 - protein, 108 aa, Artificial Sequence [sequence omitted]

SEQ ID NO: 240 - protein, 108 aa, Artificial Sequence [sequence omitted]

SEQ ID NO: 241 - protein, 640 aa, Artificial Sequence
  Transgucosidase
MSFRSLLALSGLVCTGLANVISKRATLDSWLSNEATVARTAILSNIGADGAWVSGADSGIVVASPSTDNPDYFYTWTRDSGLVLKTLVDLFRNEDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTPLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 242 - protein, 640 aa, Artificial Sequence; identical to SEQ ID NO: 167
  Transgucosidase ADX86749.1

SEQ ID NO: 243 - protein, 640 aa, Artificial Sequence; identical to SEQ ID NO: 167
  Transgucosidase AEE60909.1

SEQ ID NO: 244 - protein, 108 aa, Artificial Sequence [sequence omitted]

SEQ ID NO: 245 - protein, 957 aa, Artificial Sequence; identical to SEQ ID NO: 208
  Transgucosidase CCO73840.1

SEQ ID NO: 246 - protein, 985 aa, Artificial Sequence; identical to SEQ ID NO: 168
  Transgucosidase BAM72725.1

SEQ ID NO: 247 - protein, 655 aa, Artificial Sequence [sequence omitted]

SEQ ID NO: 248 - protein, 985 aa, Artificial Sequence
  TransgucosidaseAIY23066.1
MVKLTHLLARAWLVPLAYGASQSLLSTTAPSQPQFTIPASADVGAQLIANIDDPQAADAQSVYPGYKASKVQHNSRGFTASLQLAGRPCNVYGTDVESLTLSVEYQDSDRLNIQILPTHVDSTNASWYFLSENLVPRPKASLNASVSQSDLFVSWSNEPSFNFKVIRKATGDALFSTEGTVLVYENQFIEFVTALPEEYNLYGLGEHITQFRLQRNANLTIYPSDDGTPIDQNLYGQHPFYLDTRYYKGDRQNGSYIPVKSSEADASQDYISLSHGVFLRNSHGLEILLRSQKLIWRTLGGGIDLTFYSGPAPADVTRQYLTSTVGLPAMQQYNTLGFHQCRWGYNNWSDLADVVANFEKFEIPLEYIWTDIDYMHGYHNFDNDQHRFSYSEGDEFLSKLHESGRYYVPIVDAALYIPNPENASDAYATYDRGAADDVFLKNPDGSLYIGAVWPGYTVFPDWHHPKAVDFWANELVIWSKKVAFDGVWYDMSEVSSFCVGSCGTGNLTLNPAHPSFLLPGEPGDIIYDYPEAFNITNATEAASASAGASSQAAATATTTSTSVSYLRTTPTPGVRNVEHPPYVINHDQEGHDLSVHAVSPNATHVDGVEEYDVHGLYGHQGLNATYQGLLEVWSHKRRPFIIGRSTFAGSGKWAGHWGGDNYSKWWSMYYSISQALSFSLFGIPMFGADTCGFNGNSDEELCNRWMQLSAFFPFYRNHNELSTIPQEPYRWASVIEATKSAMRIRYAILPYFYTLFDLAHTSGSTVMRALSWEFPNDPTLAAVETQFMVGPAIMVVPVLEPLVNTVKGVFPGVGHGEVWYDWYTQAAVDAKPGVTTTISAPLGHIPVYVRGGNILPMQEPALTTREARQTPWALLAALGSNGAASGQLYLDDGESIYPNATLHVDFTASRSSLRSSAQGRWKERNPLANVTVLGVNKEPSAVTLNGQAVFPGSVTYNSTSQVLFVGGLQNLTKGGAWAENWVLEW

SEQ ID NO: 249 - protein, 640 aa, Artificial Sequence
  Transgucosidase AIY23067.1
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAASSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 250 - protein, 680 aa, Artificial Sequence
  Transgucosidase GAQ47522.1
MDPANEYCGLEDYGLVGDMHTCALVSKNGSVDSMCWPVFDSPSIFCRILDKEKGGHFSITPDRRLKNPLSKQRYRPYTNMLETRWIHEEGVVNILDYFPIAKPKPHVVEKGLPQWCRCYQNKGSAQQEACRSGMVRKAECVRGEMEIEIELFPAFNYARDSHIAQQSSASDDGIQVYHFQSESQNLVVSVLGDKGDISEDDSDLSIEFELSDRPGHLGPGLIGKVTLKEGQSVTMLLHDQESITCNAQDLAPYLQQIERTTGDFWSDWTSKCTFRGHYREQVERSLLVLKLLTYKPTGAIVAAPTFSLPEHIGGSRNWDYRYSWVRDAAFTVYVFLKNGYPEEAESYINFIFERIFPPMDKNPKPGEPFLPIMITIHGEREIPEMELDHLEGYRGSRPVRIGNGAATHIQLDIYGELMDSIYLYNKHAADISYDQWRAIRRMIDFVIQIRHQPDQSIWEVRGPPQNFVYSKIMLWVALDRGVRLAEKRSNLPCPDRARWMHERDALYDEIMTKGYNAEKGFFCMSYENQDAMDAAVLIAPLVFFVAPNDPRLLSTIQKITDVPAKGGLSVANMVSRYDTGKVDDGVGGNEGAFLMVTFWLVEAMMRAAKSKAYLPHDPFFQQLRKTATSQFDSILSFANHLGMFSEEVATSGEQIGNMPQAFSHLACVSAAMNLGGGGDR

SEQ ID NO: 251 - protein, 643 aa, Artificial Sequence
  Transgucosidase GAQ47133.1
MSFRSLLALSGLVCSGLASVISKRATLDSWLSNEATVARTAILNNIGADGAWVSGADSGIVVASPSTDNPDYFYTWTRDSGLVIKTLVDLFRNGDTDLLSTIENYISSQAIVQGISNPSGDLSSGGLGEPKFNVDETAYTGSWGRPQRDGPALRATAMIGFGQWLLLTGQDNGYTSAATEIVWPLVRNDLSYVAQYWNQTGYDLWEEVNGSSFFTIAVQHRALVEGSAFATAVGSSCSWCDSQAPQILCYLQSFWTGEYILANFDSSRSGKDTNTLLGSIHTFDPEAGCDDSTFQPCSPRALANHKEVVDSFRSIYTLNDGLSDSEAVAVGRYPEDSYYNGNPWFLCTLAAAEQLYDALYQWDKQGSLEITDVSLDFFQALYSDAATGTYSSSSSTYSSIVDAVKTFADGFVSIVETHAASNGSLSEQYDKSDGDELSARDLTWSYAALLTANNRRNSVVPPSWGETSASSVPGTCAATSASGTYSSVTVTSWPSIVATGGTTTTATTTGSGSVTSTSKTTTTASKTSTTTSSTSCTTPTAVAVTFDLTATTTYGENIYLVGSISQLGDWDTSDGIALSADKYTSSNPLWYVTVTLPAGESFEYKFIRIESDDSVEWESDPNREYTVPQACGESTATVTDTWR

SEQ ID NO: 252 - protein, 587 aa, Artificial Sequence
  Transgucosidase GAQ46031.1
MAKSASQIHRAWWKECSVYQIWPASYKDSNDDGIGDIPGIISKLDYIKNIGVDIVWLCPSYKSPQVDMGYDIADYYSIADEYGTVADVEKLIQGCHERGMKLLMDLVVNHTSDQNEWFKQSRSSKDNEYRNWYVWKPARYDEQGNRHPPNNWVSHFQGSAWEWDEHTQEYYLHLYAVEQPDLNWEHPPVRKAVHDIMRFWLDKGADGFRMDVINFVSKDQRFPDAPVKDPRTPWQWGDKYYANGPRLHEYLADLGKILKEYDAFSVGEMPFVRDTEEVLRAVRYDRNEINMIFNFEHVDIDHGTYDKFEPGSWKLTDLKAFFETWQKFMYNNDGWNALYWENHDQPRSIDRYAQAKEEFRTEAGKMLATVLALQSGTPFVYQGQEIGMRNVPIEWDMNEYKDIDCLNHWHRLLKHRPDDIEAQKSARQEYQKKSRDNGRTPVQWSSAPNGGFTGPNAKPWMSVNPDYVRFNAEAQVNDPNSIYHYWAAVLGLRKKYLDIFVYGDYDLVDKDSQEIFAYSRQYEDQKALVLTNWTENTLEWDATANGVKGVKDVVLNSYESAEAAKGRFSGQKWSLRPYEAVVLLVEA

SEQ ID NO: 253 - protein, 676 aa, Artificial Sequence
  Transgucosidase GAQ44395.1
MRCHRLLSGVLAFLPLSVAQSCWRNTTCSGPTDSAFSGPWEKNIFAPSSRTLNPEKLFLITQPDKTEDYIPFALHGNGSLVVYDFGKEVGGIVSVNFSSTGSGALGVAFTEAKNYIGEWSDSSNGGFKGPDGALYGNFTEAGSHYYVMPDKSLRGGFRYLTLFLITSDNSTIHIEDVSLEIGFQPTWSNLKAYQGYFHSNDDLLNKIWYTGAYTLQTNEVPTDTGRQIPAMAEGWANNCTLGPGDTIIVDGAKRDRAVWPGDMGIAVPSAFVSLGDLDSVKNALQVMYDTQDNSTGAFDESGPPLSQKDSDTYHMWTMVGTYNYMLYTNDSDFLEQNWEGYQKAMDYIYGKVTYPSGLLNVTGTRDWARWQQGYNNSEAQMILYHTLNTGAELATWAGDSGDLSSTWTSRAEKLRQAINEYCWDESYGAFKDNATDTTLHPQDANSMALLFGVVDADRAASISERLTDNWTPIGAVAPELPENISPFISSFEIQGHLTVGQPQRALELIRRSWGWYYNNANGTQSTVIEGYLQNGTFGYRGSRGYYYDTAYVSHSHGWSSGPTSALTNYIVGITVTSPLGATWRIAPQFVDLQSAEGGFTTSLGKFQAGWSKTDKGYTLDFTVPHGTQGNLTLPFVGTAKPSIKIDGTEITRGVQYANSTATVTVSGGGTYKVVVQ

SEQ ID NO: 254 - protein, 779 aa, Artificial Sequence
  Transgucosidase GAQ43928.1
MRFRDGMWLVDPSKSLQYAEDIYSINASPDNRSLNLLCPTRHIFSRGNTLNLSTLHINLESHFDGVISLEVQHWLGARKGTPDFELFPDGEGPKLSEERIGISKSERGTTLKSGALSVTVSPDQHDFSIRFHSSDDYDWEVTSLLNRSVGLAYDPPISNGKQVEDLVQGQSGSRKHYIFTQTELDIGESVHGLGERFGPFNRLGQHVEIWNEDGGTSSDQAYKNVSFWMSSKGYGVFIDTPEKVDLEIGSERCCRVQTSVEGQRLKWYIIYGPSPKEVLTKYSVLTGRAPMVPAWSFGLWLTTSFTTNYDEATVTDFLQQMSDRSIPVEVFHYDSFWMRAFHWCDFVFSPDHFPDPKGSIARIKHAGLTNKVCVWINPYLGQASPVFLEAAEKGYLLKRTNGDVWQWDLWQTGMGLVDFTNPEAVRWYEGCLERLFDVGIESIKTDFGERIPTKGVKWHDESVDPARMHNYYAFIYNKIVYNALTRRYGDGQAVLFARSACAGVQRFPLCWGGDCESTPAALAESVRGGLSIGLSSFSFWSCDIGGFEGTPPPWIYKRWVAFGLLCSHSRLHGSDSYRVPWLIDNDDAGPQGSTAVLRTFVRLKRRLMPYLYTQAVQSTRMGWPLSLRATALEFPHDPTAWAACDRQFFVGENLLVAPVFTEHGDVEFYLPEGQWTSLWDEKKVVSGPGWRREKHGFGTLPIYVREGAVIVMGKEQGEGGFAYDWCEAPEVRLYQTKQGDCATVVDASGKEVGTLTVQDDGSLKGLECFRGDVTVRRIE

SEQ ID NO: 255 - protein, 629 aa, Artificial Sequence
  Transgucosidase GAQ43980.1
MDFFQTFWSSSPLSKIPSSSFNQTFMCTMCPKSNYTTPKWWKEAVVYQVYPASFNCGKPTSKTNGWGDVTGIIDKVPYLKSLGVDIVWLSPIYTSPHVDMGYDIADYKSIDPRYGTLADVDLLIKALRNHDMKLMMDLVVNHTSDQHSWFVESASSKYSPKRDWYIWRPAKGFDDDGNPVPPNNWAQILGDALSAWTWHEETREFYLTLHTSAQVELNWENPEVVAAVYDVMEFWLRRGICGFRMDVINLISKDQSFPDAPIIDPTSKYQPGEQFYTNGPRFHEFMHGIYDNVLSKYDTITVGETPYVTDIEEIIKTVGSTAKELNMAFNFDHMEIEDVKTKGDSKWSLRDWKLTELKGILSGWQKRMKKWDGWNAIFLECHDQARSVSRYTIDSDEFRERGAKLLALLETTLGGTIFLYQGQEIGMRNFPLEWDPDIEYKDVESVNFLNKSKELHPVGTEGLAKARTLLQKKARDHARTPMQWSAAPHAGFTVPDATPWMRVNDDYETVNVETQMSFPWQSKGELSVWQYWQQAIQHRKLYKNAFVYGGFEDLDYHNEKVFAYLRTSADGNDSWLVAMNWTTSAVEWTVPSDIHVTRWVSSTLQTAPPVASKTVITLRAFEGVLGCCN

SEQ ID NO: 256 - protein, 963 aa, Artificial Sequence
  Transgucosidase GAQ43844.1
MAGTRPMSNRWTLLLSLVILLGCLVIPGVTVKHENFKTCSQSGFCKRNRAFADDASAQGPSWTSPYELDSSSIQFKDGQLHGTILKSVSANEKVKLPLVVSFLESGAARVVVDEEKRLNGEIQLRHDSKARKERYNEAEKWVLVGGLELSKTATLKPETETGFTRVLYGPDNQFEAVIRHAPFSADFKRDGQTHVQLNNKGYLNMEHWRPKVEVEGEGEQQTQEDESTWWDESFGGNTDTKPRGPESVGLDITFPGYKHVFGIPEHADSLSLKETRGGEGNHEEPYRMYNADVFEYELNSPMTLYGAIPFMQAHRKDSTVGVFWLNAAETWVDIVKSTSSPNPLALGVGATTDTQSHWFSESGQLDVFVFLGPTPQEISKTYGELTGYTQLPQHFAIAYHQCRWNYITDEDVKEVDRNFDKYQIPYDVIWLDIEYTDDRKYFTWDPLTFPDPISMEEQLDESERKLVVIIDPHIKNQDKYSISQEMTSKDLATKNKDGEIYDGWCWPGSSHWIDTFNPAAIKWWISLFKFDKFKGTLSNVFIWNDMNEPSVFNGPETTMPKDNLHHGNWEHRDIHNVHGITLVNATYDALLERKKGEVRRPFILTRSYYAGAQRMSAMWTGDNQATWEHLAASIPMVLNNGIAGFPFAGADVGGFFHNPSKELLTRWYQAGIWYPFFRAHAHIDTRRREPYLIAEPHRSIISQAIRLRYQLLPAWYTAFHEASVNGMPIVRPQYYAHPTDEAGFAIDDQLYLGSTGLLAKPVVSEEATTADIYLADDEKYYDYFDYTVYQGAGKRHTVPAPMETVPLLMQGGHVIPRKDRPRRSSALMRWDPYTLVVVLDKNGQADGSLYVDDGETFDYERGAYIHRRFRFQESALVSEDVGTKGPKTAEYLKTMANVRVERVVVVDPPKEWQGKTSVTVIEDGASAASTAPMQYHSQSDGKAAYAVVKNPNVGIGKTWRIEF

SEQ ID NO: 257 - protein, 1468 aa, Artificial Sequence
  Transgucosidase GAQ42954.1
MLLHLLAYAALSSVVTAASLQPRLQDGLALTPQMGWNTYNHYSCSPNETIVRSNAQALVDLGLSSLGYRYVTTDCGWTVADRLPDGSLTWNETLFPQGFPAMGDFLHDLGLLFGVYQDSGILLCGSPPNETGSLYHEAQDARTFASWNVDSLKYDNCYSDAATNYPNVNYAPSTSPEPRFANMSHALLQQNRTILFQICEWGISFPAGWAPALGHSWRIGNDIIPAWRTIFRIINQAAPQTDFAGPGQWPDLDMLEVGNNIFSLPEEQTHFSLWAILKSPLIIGAALKDELTAINDASLAVLKQKDVVAFNQDALGKSASLRRRWTEEGYEVWSGPLSNGRTVAAVINWRNESRDLTLDLPDIGLQHAGTVKNIWDGTTAQNVVTSYTATVAGHGTMLLELQNTTAVGVYPRDVFGESSGQTTTFENIYAVTTSAKYTVSVYFSQPASSAETISIGSNANQSIISVQVPASSTLVSANIPLTAGSSNTVTINTSIPIDAIHITAPNGTYYPCTNFTLAGSTTLTTCGSGYCQPVGSKIGYISPSGTAKATISATTSGSKYLEIDWINNEIAFDSSWGWGSNSRNLTVTVNSEEPVRIEVPLSGRHSELFGPGLGWWDTATLGLLTSGWKEGLNEVIVGNVGGDEGFQSYGADFEILRSNFEKMKVSLTLYAAALQLADAAVVQKRTVDVAELEHYWSYGRSEPVYPTPETSGSGDWEEAFTKAKSLVAQMTNDEKNNITYGYTSTTNGCSGMSGGVPRLGYPGMCLQDAASGVRGTDMVNAYASGLHIGASWNRDLAYEHAHYMGAEFKRKGANVALGPVVGPLGRMARGGRNWEGYSNDPYLSGSLVQNTIRGLQESVIACVKHFIGNEQETNRNTPQLLEDSYNQSVSSNIDDKTIHELYLWPFQDAVKAGAGAVMCSYNRINNSYGCQNSKNLNGLLKGELGFQGFVVSDWNAQQSGIASAAAGLDMVMPDSVYWENGNLSLAVRNGSLSSTRLDDMATRIVAAWYKYAELEDPGFGMPISLLEPHDPVDARDPASKATILQEAIEGHVLVKNTDNALPLKEPKFLSLFGYDAIAAQRNTMDDLSWSLWTMGLDNTLSYPNGTAVDPSHLKYMFLSSTNPSENGPGVSLNGTMISGGGSGASTPSYIDAPFDAFQRQAYEDNTFLAWDFASQSPVVNPASEACLVFINEAAAEGWDRPYVADPYSDTLVENVASQCNNTMVIIHNAGIRLVDRWVDNPNVTAVIYGHLPGQDSGRALVEIMYGKQSPSGRLPYTVAKNASDYGALLSPVVPEGTKDLYYPQDNFTEGVYIDYKAFEQKNITPRYEFGYGLTYSTFDYSGLKISIHTGVNTDYLPPNSTIEEGGIPALWDVVATVTCSVANTGSVAAAEVAQLYLGIPGGPAKVLRGFEKKLIQPGHHTKVQFDLTRRDLSSWDVVNQAWVLQKGDYSVYVGKSVLDTQLTGTLTI

SEQ ID NO: 258 - protein, 1181 aa, Artificial Sequence
  Transgucosidase GAQ42198.1
MAVSASSPEPLGANIDERTPLNSSAQHATPSANTPDYSSITKGLTSDVHSSHGSDEEQPLINPPESPGKDVTALTSISTVIGVLLLGEFISNADATLVMAATGRISSEFNRLRDASWLSTAYTLGLCAAQPMYGKLSDIYGRKPLLLWAYFLFGVGCVISGIGPDMATVILGRAISGIGGAGTMAMGSIIITDIVPRRDVAHWRAYINIAMTLGRSAGGPVGGWLTDTIGWRWSFIIQGPLAAVAALLVVWKLKLVHPVTEKSIRRVDFLGTFLLATGIITITVIMDQAGQSFAWASLSTAILSTLSLSAFVAFVLVELYVAPEPIFELRMLRKPNVTPSYLIGSLQITAQVGMMFSVPLYFQVTSKASATVAGGHLVPAVIGNTLGGLIAGAFIRRTGQFKVLLILAGLVASVAYLLLFLRWNGHTGFWESLYIIPGGMGTGFCSAAAFVSMTAFLMPQEVAMATGGYFLLFSFAMTAGVTVTNSLLGTVFKRQMEQHLTGPGAKKIIERALSDTSYINGLQGHVRDVVVKGYVAGLRYTYPMRVSISSLALSVYLFGKLALGLSAAEWRTQSIYFLLTDRFGRADNSTTATCDTGDQIYCGGSWQGIINHLDYIQGMGFTAIWISPITEQLPQDTSDGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQDYLDGVLNYPIYWQLLYAFESSSGSISDLYNMIKSVASDCSDPTLLGNFIENHDNPRFASYTSDYSQAKNVLSYIFLSDGIPIVYAGEEQHYSGGDVPYNREATWLSGYDTSAELYTWIATTNAIRKLAISADSDYITYANDPIYTDSNTIAMRKGTSGSQVITVLSNKGSSGSSYTLSLSGSGYTSGTELIEAYTCTSVTVDSNGDIPVPMASGLPRVLLPASVVDSSSLCGGSGSTTTTAATSTSTSKATSSTTTTTAITTTSSSCTATSTTLPITFEELVTTTYGEEIYLSGSISQLGEWDTSDAVKLSADDYTSSNPEWYVTVSLPVGTTFEYKFIKVEEDGSVTWESDPNREYTVPECGSGETVVDTWR

SEQ ID NO: 259 - protein, 768 aa, Artificial Sequence
  Transgucosidase GAQ39994.1
MPLTYLGALAMLTALPSLGQARSTWPLGSGLELSYQASQHQISIHQDNQTIFSTLPGQPFLSAGAGKDQIVEDSGNFNITNVAQARCQGQNITQLAGIPRRDSVKNQVAVRGYLLDCGGEDIAYAMNFWVPKTLSDRVAFEATVDSDANASVPVERLYLTFASHAREDFYGLGAQASFASMKNRSIPIFSREQGVGRGDQPYTAIEDSQGFFSGGDQYTTYTAIPQYVSSDGRVFYLDENDTAYAVFDFQRPDAVTVRYDSITVHGHLMQADNMLDAITMLTEYTGRMPALPEWVDHGALLGIQGGQEKVNRIVKQGFEHDCPVAGVWLQDWSGTHLQSAPYGNMNISRLWWNWESDTSLYPTWAEFVQALREQHGVRTLAYVNPFLADVSSKSDGYRRNLFQEASKHRYMVQNTTTNSTAIISSGKGIDAGILDLTNEETRAWFADVLRTQVWSANISGCMWDFGEYTPITADTSLANISTSAFFYHNQYPRDWAAYQRSVAAEMPLFHEMVTFHRSASMGANRHMNLFWVGDQATLWTPNDGIKSVVTIQGQMGISGYAHSHSDIGGYTTVFEPPTTSNSSGAIPRSAELLGRWGELGAVSSAVFRSHEGNVPSVNAQFYSNSTTYAYFAYNARMFRSLGPYRRRILNTESQRRGWPLLRMPVLYHPEDLRARQISYESFFLGRDLYVAPVLDEGRKSVEVYFPGHSANRTYTHVWSGQTYRGGQTAQVSAPFGKPAVFVVDGASSPELDVFLDFVRKENGTVLRA

SEQ ID NO: 260 - protein, 985 aa, Artificial Sequence
  Transgucosidase GAQ38166.1
MVKLTDLLARAWLVPLAYGASQSRLSTTTSSQPQFTIPASADVGAQLIANIDDPQAANAQSVCPGYKASKVQHNSRGFTASLQLAGRPCNVYGTDVDSLTLSVEYQDSDRLNIQILPTHVDSTNASWYFLSENLVPRPKASLNASVSDSDFSVSWSNEPSFNFKVIRKATGDALFSTEGTVLVYEDQFIEFVTALPEEYNLYGLGEHITQFRLQRDANLTIYPSDDGTPIDKNIYGQHPFYLDTRYYKGDRQNGSYVPVKSSETDASQKYISLSHGVFLRNSHGLEILLRPQKLIWRTLGGGIDLTFYSGPNPADVTRQYLTSTVGLPAMQQYSTLGFHQCRWGYNNWSDLADVVANFEKFEIPLEYIWTDIDYMHGYRNFDNDQNRFSYSEGDEFLSKLHESGRYYVPIVDAALYIPNPENASDAYATYDRGAADDVFLKNPDGSLYIGAVWPGYTVFPDWHHPKAVEFWANELVIWSKKVAFDGVWYDMSEVSSFCVGSCGTGNLTLNPAHPPFLLPGEPGDIIYDYPEAFNITNATEAASASAGASSQAAATATSTSTSVSYLRTTPTPGVRNVEHPPYVINHDQEGHDLSVHAVSPNATHIDGVEEYDVHGLYGHQGLNATYHGLLEVWSHERRPFIIGRSTFAGSGKWAGHWGGDNYSKWWSMYYSISQALSFSLFGIPMFGADTCGFTGNSDEELCNRWMQLSAFFPFYRNHNELSTIPQEPYRWASVIEATKSAMRIRYAILPYFYTLFDLAHTTGSTVMRALSWEFPNDPTLAAVETQFMVGPAIMVIPVLEPLVNTVKGVFPGVGHGEVWYDWYTQAAVDAKPGVNTTISAPLGHIPVYVRGGNILPMQEPALTTRGARQTPWALLAALGSNGTASGQLYLDDGESIYPNATLRVGFTASRSSLRSSAQGRWKERNPLANVTVLGVNKEPSAVTLNGKTVSPGSITYNSTSQVLFVGGLQNLTNGGAWAENWVLEW

SEQ ID NO: 261 - protein, 866 aa, Artificial Sequence
  Transgucosidase GAQ36312.1
MLGSLLFLLPLVGAAVIGPRAGSQSCPGYKASNVQKSARSLTADLTLAGAPCNSYGKDVEDLKLLVEYQTDERLHVMIYDADEEVYQVPESVLPRVGSDKDSQDSVLEFDYVEEPFSFTISKGDEVLFDSSASTLIFQSQYVRLRTWLPDDPYVYGLGEHSDPMRLPTYNYTRTLWNRDAYGTPNNTNLYGSHPVYYDHRGKSGTHGVFLLNSNGMDIKINQTTDGKQYLEYNLLGGVLDFYFFYGEDPKQASMEYSKIVGLPAMQSYWTFGFHQCRYGYRDVYELAEVVYNYSQAKIPLETMWTDIDYMDKRRVFTLDPQRFPLEKMRELVTYLHNHDQHYIVMVDPAVSVSNNSAYLTGVRDNVFLHNQNGSLYEGAVWPGVTVFPDWFNEDTQDYWTAQFQQFFDPKSGVDIDALWIDMNEASNFCPYPCLDPAAFAISDDLPPAAPPVRPSSPIPLPGFPADFQPSSKRSVKRAQGDKGKKVGLPNRNLTDPPYTIRNAAGVLSMSTIETDLIHAGEGYAEYDTHNLYGTMMSSASRTAMQARRPDVRPLVITRSTFAGAGAHVGHWLGDNLSDWVHYRISIAQILSFASMFQIPMVGADVCGFGSNTTEELCGRWASLGAFYTFYRNHNELGDIPQEFYRWPTVAESARKAIDIRYRLLDYIYTALHRQSQTGEPFLQPQFYLYPEDSNTFANDRQFFYGDALLVSPVLNEGSTSVDAYFPDDIFYDWYTGAVVRGHGENITLSNINITHIPLHIRGGNIIPVRMSSGMTTTEVRKQGFELIIAPDLDGTASGSLYLDDGDSLNPSSVTELEFTYSNGELHVQGTFGQKAVPKVEKCTLLGKSARTFKGFALDAPVNLKLK

SEQ ID NO: 262 - protein, 2359 aa, Artificial Sequence
  Transgucosidase GAQ33831.1
MSSPQQVYLLPLKDDGSPDVPGGYLYLPSPTDPPYLLRFVIEGSSSICREGALWVNIPEKGESFNRSAFRSFSLSPDFNKNIQIDIPITSAGSFAFYVTFSPLPEFSVLSTPTPEPTRTPTHYIDVSPKLTLRGQDLPLNALSIYSVISKFMGQYPKDWEKHLNGISQRNYNMVHFTPLMKRGASNSPYSIFDQLQFDDAVFPNGEDDVARLVSKMEDEYGLLSLTDVVWNHTAHNSKWLEEHPEAGYSVETAPWLEAALELDTALLKFGQELSTLGLPTEFHTVDELMEVMNAMRDKVISGIRLWEFYAIDVKADTQRILDQWKTSKDLNLTDKKWAQLNLSDYKNWTLKQQATFIREYAIPTSKQVLGRFSRAVDLHFGAAILTALFGPHDSPTSDTNTVEESLSKILDEVNLPFYEEYDGDVSEIMNQVFNRIKYLRIDDHGPKLGAVTAQSPLIETYFTRLPLNDVTKKHKKGALALVNNGWIWNADALRDNAGPDSRAYLRREVIVWGDCVKLRYGSCRDDNPFLWDFMTDYTRLMAKYFSGFRIDNCHSTPLVVAEYLLDEARKVRPNLTVFAELFTGSEEADYIFVKRLGINALIREAMQAWSTGELSRLVHRHGGRPIGSFDLDLPSSGSSHAIASSGLDSGKEKVAHIRPTPVQALFMDCTHDNEMPAQKRTAKDTLPNGALVAMCASAIGSVIGYDEVYPRLVDLVHEHRLYFSEFSEAPETGLNSLEGGIGGIKKLLNDLHTRMGVEEYDETHIHHDGEYITVHRVHPRTRKGVFLIAHTAFSGQDGKSVLAPTHLVGTHVKHIGTWLLEVDASQTTKERIQTDKSYLRGLPSQVKTFEGTKIEESGKDTIISVLDSFVAGSIALFETSMPSVEHASGLDNYITEGVDHAFSDLSLVDLNFALYRCEAEERDSSKGQDGVYDIPGHGPLVYAGLQGWWSVLENIIKYNELGHPLCDHLRNGQWALDYIVARLEKLGHTDEHTALGRPAAWLQEKFQAVRQLPSFLLPRYFAIIVQVAYNAAWKRGIQLLGPHIQNGQEFIHQLGMVSVQQTGYVNSASLWPTKKVPSLAAGLPHFAVDWARCWGRDVFISLRGLLLCTSRFEDAKEHITAFASVLKHGMIPNLLSSGKLPRYNSRDSVWFFLQSIQDYTKMAPDGLRLLDHNVPRRFLPYDDVWFPYDDPRAYSQHSTISEIIQEVLQRHAQGLSFREYNAGPDLDMQMTQEGFQIDVKVDWETGLIFGGSQYNCGTWQDKMGESAKAGNKGVPGTPRDGAAIEITGLVYSALTWVAELHERGLYKHDGVDIGDGKSISFKEWASRIQANFERCYYVPLQPKDDGQYDIDANIINRRGIYKDLYRSGKPYEDYQLRSNFPIAMTVAPDLFTSSKALAALALADEVLVGPVGMATLDPSDLNYRPNYNNSEDSTDFATAKGRNYHQGPEWVWQRGYFLRAFLHFDLARRTTPAERTETYQQITRRLEGCKRALRESPWKGLTELTNKNGAHCADSNICFWSVMSLTESAAAAMLTAAVVVDSPIDVHEPRWDDQTRGRDLYTQLVISLLVGLSAFFSFCVLRPKWTELYAARRRQRCAASYLPELPDSFFGWIPVLYRITDEQVLESAGLDAFVFLTFLKFAIRFLSAIFFFALVIILPTHYKNTGKSGVPGWDDDDDETFDGDKDKKKIISDPNYLWMYVIFTYIFTGLAVYMLIQETNKVIRTRQKYLGSQTSTTDRTIRLSGIPPDLGTEEKIKDFMEGLKVGKVESVTLCRDWRELDHLIDERLKLLRNLERAWTRHLGYKRVKASPNALTLMHQQPRGSSIVSDGESERIQLLSEGGRDHVTDYAHKRPTVRIWYGPFKLRYKNIDAIDYYEEKLRRLDEKIQVARQKEYPPTEVAFVTMESIAASQMVVQAILDPHPMQLLARLAPAPADVVWKNTYLPRSRRMMQSWFITVVIGFLTVFWSVLLIPVAYLLEYETLHKVFPQLADALARNPLAKSLVQTGLPTLVLSLLTVAVPYLYNWLSNQQGMMSRGDIELSVISKTFFFSFFNLFLVFTVFGTATTFYGFWENLRDAFKDATTIAFALAKTLENFAPFYINFLCLQGIGLFPFRLLEFGSVAMYPINFLAAKTPRDYAELSTPPTFSYGYSIPQTVLSLIICVVYSVFPSSWLICLFGLIYFTIGKFIYKYQLLYAMDHQQHSTGRAWPMICSRILMGLIVFQLAMIGVLALRRAITRSLLIVPLLMATVWFSYFFARTYEPLMKFIALKSIDRERPGGGDISPSPSSTFSPPSGLDRDSFPIRIGGQELGLRLRKYVNPSLILPLHDAWLPGRTMVPELQGELEHRNSENNAADESV

SEQ ID NO: 263 - protein, 655 aa, Artificial Sequence
  Transgucosidase GAQ33901.1
MWSSWLLSALLATEALAVPYEEYILAPSSRDLAPASVRQVNGSVTNAAALTGAGGQATFNGVSSVTYDFGINVAGIVSVDVASASSESAFIGVTFTESSMWISNEACDATQDAGLDTPLWFAVGQGAGVYSVGKKYTRGAFRYMTVVSNTTATVSLNSVKINYTASPIQDLRAYTGYFHSSDELLNRIWYAGAYTLQLCSIDPTTGDALVGLGVITSSETITLPQTDKWWTNYTITNGSSTLTDGAKRDRLVWPGDMSIALESVAVSTEDLYSVRTALESLYALQKADGQLPYAGKPFYDTVSFTYHLHSLVGAASYYQYTGDRAWLTRYWGQYKKGVQWALSSVDSTGLANITASADWLRFGMGAHNIEANAILYYVLNDAISLAQSLNDNAPIRNWTATAARIKTVANELLWDDKNGLYTDNETTTLHPQDGNSWAVKANLTLSANQSAIISESLAARWGPYGAPAPEAGATVSPFIGGFELQAHYQAGQPDRALDLLRLQWGFMLDDPRMTNSTFIEGYSTDGSLVYAPYTNRPRVSHAHGWSTGPTSALTIYTAGLRVTGPAGATWLYKPQPGNLTQVEAGFSTRLGSFASSFSRSGGRYQELSFTTPNGTTGSVELGDVSGQLVSEGGVKVQLVGGKASGLQGGKWRLNV

SEQ ID NO: 264 - protein, 676 aa, Artificial Sequence
  Transgucosidase EHA19108.1
MRWHKLLPGVLALLPLSVAQSCWRNTTCSGPTESAFSGPWEKNIFAPSSRTVNPEKLFLITQPDKTEEYSPFALHGNGSLVVYDFGKEVGGIVSVNFSSTGSGALGVAFTEAKNWIGEWSDSSNGGFKGPDGALYGNFTEAGSHYYVMPDKSLRGGFRYLTLFLITSDNSTIQIEDVNLEIGFQPTWSNLKAYQGYFHSNDDLLNKIWYTGAYTLQTNEVPTDTGRQIPAMAVGWANNCTLGPGDTIIVDGAKRDRAVWPGDMGIAVPSAFVSLGDLDSVKNALQVMYDTQNNSTGAFDESGPPLSQKDSDTYHMWTMVGTYNYMLFTNDSDFLERNWEGYQKAMDYIYGKVTYPSGLLNVTGTRDWARWQQGYNNSEAQMILYHTLNTGAELATWAGDSGDLSSTWTSRAEKLRQAINEYCWDDSYGAFKDNATDTTLHPQDANSMALLFGVVDADRAASISERLTDNWTPIGAVAPELPENISPFISSFEIQGHLTVGQPQRALELIRRSWGWYYNNANGTQSTVIEGYLQNGTFGYRSDRGYYYDTAYVSHSHGWSSGPTSALTNYIVGISVTSPLGATWRIAPQFVDLQSAEGGFTTSLGKFQAGWSKTDKGYTLDFTVPHGTQGNLTLPFVSAAKPSIKIDGTEISRGVQYANSTATVTVSGGGTYKVEVQ

SEQ ID NO: 265 - protein, 847 aa, Artificial Sequence; identical to SEQ ID NO: 230
  Transgucosidase EHA19157.1

SEQ ID NO: 266 - protein, 593 aa, Artificial Sequence
  Transgucosidase EHA19519.1
MRLSTSSLLLSVSLLGKLALGLSAAEWRTQSIYFLLTDRFGRTDNSTTATCNTGDQIYCGGSWQGIINHLDYIQGMGFTAIWISPITEQLPQDTADGEAYHGYWQQKIYDVNSNFGTADDLKSLSDALHARGMYLMVDVVPNHMGYAGNGNDVDYSVFDPFDSSSYFHPYCLITDWDNLTMVQDCWEGDTIVSLPDLNTTETAVRTIWYDWVADLVSNYSVDGLRIDSVLEVEPDFFPGYQEAAGVYCVGEVDNGNPALDCPYQEYLDGVLNYPIYWQLLYAFESSSGSISDLYNMIKSVASDCSDPTLLGNFIENHDNPRFASYTSDYSQAKNVLSYIFLSDGIPIVYAGEEQHYSGGKNDAFYTDSNTIAMRKGTSGSQVITVLSNKGSSGSSYTLTLSGSGYTSGTKLIEAYTCTSVTVDSSGDIPVPMASGLPRVLLPASVVDSSSLCGGSGSNSSTTTTTTATSSSTATSKSASTSSTSTACTATSTSLAVTFEELVTTTYGEEIYLSGSISQLGDWDTSDAVKMSADDYTSSNPEWSVTVTLPVGTTFEYKFIKVESDGTVTWESDPNREYTVPECGSGETVVDTWR

SEQ ID NO: 267 - protein, 985 aa, Artificial Sequence; identical to SEQ ID NO: 168
  Transgucosidase EHA20839.1

SEQ ID NO: 268 - protein, 640 aa, Artificial Sequence; identical to SEQ ID NO: 167
  Transgucosidase EHA21384.1

SEQ ID NO: 269 - protein, 587 aa, Artificial Sequence
  Transgucosidase EHA23512.1
MAKSASQIHRAWWKECSVYQIWPASYKDSNDDGIGDIPGIISKLDYIKNIGVDIVWLCPSYKSPQVDMGYDIADYYSIADEYGTVADVEKLIQGCHERGMKLLMDLVVNHTSDQNEWFKQSRSSKDNEYRNWYVWKPARYDEQGNRHPPNNWVSHFQGSAWEWDEHTGEYYLHLYATEQPDLNWEHPPVRKAVHDIMRFWLDKGADGFRMDVINFISKDQRFPDAPVKDPRTPWQWGDKYYANGPRLHEYLQDLGKILKEYDAFSVGEMPFVRDTEEVLRAVRYDRNEINMIFNFEHVDIDHGTYDKFEPGSWKLTDLKAFFETWQKFMYNNDGWNALYWENHDQPRSIDRYAQAKEEFRTEAGKMLATVLALQSGTPFVYQGQEIGMRNVPVEWDMNEYKDIDCLNHWHRLLKHRPDDIEAQKSARQEYQKKSRDNGRTPVQWSSAPNGGFTGPNAKPWMSVNPDYVRFNAEAQVNDPNSIYHYWAAVLGLRKKYLDIFVYGDYDLVDKDSQEVFAYARQFENQKALVLTNWTEKTLEWDATANGVKGIKDVLLNSYESAEAAKERFTGQKWSLRPYEAVVLLVEA

SEQ ID NO: 270 - protein, 768 aa, Artificial Sequence
  Transgucosidase EHA23680.1
MPSTYLGALATLAVFPCLGQARSTWPLGSGLELSYQASQHQISIHQDNQTIFSTIPGQPFLSASAGKDQFVEDSGNFNITNVNQARCRGQNITQLAGIPRSDSVKNQVAVRGYLLDCGGEDIAYGMNFWVPRRFSDRVAFEATVDSEANASVPVDRLYLTFASHALEDFYGLGAQASFASMKNRSIPIFSREQGVGRGDQPYTAIEDSQGFFSGGDQYTTYTAIPQYVSSDGRVFYLDENDTAYAVFDFQRSDAVTVRYDSLSVHGHLMQADTMLDAITMLTEYTGRMPTLPEWVDHGALLGIQGGQEKVNRIVKQGFEHDCPVAGVWLQDWSGTHLQSAPYGNMNISRLWWNWESDTSLYPTWAEFVQTLREQHGVRTLAYVNPFLANVSSKSDGYRRNLFLEASQHRYMVQNTTTNSTAIISSGKGIDAGILDLTNEDTRAWFADVLRTQVWSANISGCMWDFGEYTPITPDTSLANISTSAFFYHNQYPRDWAAYQRSVAAEMPLFHEMVTFHRSASMGANRHMNLFWVGDQATLWTRNDGIKSVVTIQGQMGISGYAHSHSDIGGYTTVFEPPTTSNSSGAIPRSAELLGRWGELGAVSSAVFRSHEGNVPSVNAQFYSNSTTYAYFAYNARLFRSLGPYRRRILNTESQRRGWPLLRMPVLYHPEDLRARQISYESFFLGRDLYVAPVLDEGHKSVDVYFPGHGANRTYTHVWTGQTYRAGQTAKVSAPFGKPAVFLVNGASSPELDVFLNFVRKENGTVLHA

SEQ ID NO: 271 - protein, 680 aa, Artificial Sequence
  Transgucosidase EHA25759.1
MDPANEYCGLEDYGLVGDMHTCALVSKNGSVDSMCWPVFDSPSIFCRILDKEKGGHFSITPDRRLKNPLSKQRYRPYTNMLETRWIHEEGVMNILDYFPIAKPKPHVVEKGLPQWCRCYQNKGSAQYQACRSGMVRKAECVRGEMEIEIELFPAFNYARDSHVAQQSSASDDAIQVYHFQAESQNLVVSVLGDKGDISEDDSDLSIEFELSDRPGHLGPGLVGKVILKEGQSITMLLHDQESITCDVDDLAPYLQQIERTTGDFWSDWTSKCTFRGHYREQVERSLLVLKLLTYKPTGAIVAAPTFSLPEHIGGSRNWDYRYSWVRDAAFTVYVFLKNGYPEEAESYINFIFERIFPPMDKNPKPGEPFLPIMITIHGEREIPEMELDHLEGYRGSRPVRIGNGAATHIQLDIYGELMDSIYLYNKHAADISYDQWRAIRRMIDFVIQIRHQPDQSIWEVRGPPQNFVYSKIMLWVALDRGLRLAEKRSNLPCPDRARWMHERDALYDEIMTKGYNAEKGFFCMSYENQDAMDAAVLIAPLVFFVAPNDPRLLSTIQRITEVPAKGGLSVANMVSRYDTGKVDDGVGGNEGAFLMVTFWLVEAMMRAARSKSYLPHDPFFQQLRKTATSQFDSILSFANHLGMFSEEVATSGEQIGNMPQAFSHLACVSAAMNLGGGGDR

SEQ ID NO: 272 - protein, 1539 aa, Artificial Sequence
  Transgucosidase EHA26514.1
MSSPQQVYLLPLKDDGSPDVPGGYIYLPAPTNPPYLLRFVIEGSSSICREGALWVNIPEKGESFNRSAFRSFSLSPDFNKNIQIDVPITSAGSFAFYVTFSPLPEFSVISTPTPEPTRTPTHYIDVSPKLTLRGQDLPLNALSIYSVISKFMGQYPKEWEKHLNGISQRNYNMVHFTPLMKRGASNSPYSIFDQLQFDDAVFPNGEDDVARLISKMENEYGLLSLTDVVWNHTAHNSKWLEEHPEAGYSVETAPWLEAALELDTALLKFGQDLQNLGLPTEFQTVDELMKVMNVMRDKVIAGIRLWEFYAIDVKSDTHKILDKWKTSKDIDLTDTNWAQLNLQDYKNWTLKQQATFIRDHAIPTSKQVLDRFSRAVDLQFGAAILTALFGPHNPSTSDTSIVEESLSKILDEVNLPFYEEYDGDVSEIMNQVFNRIKYLRIDDHGPKLGAVTAQSPLIETYFTRLPLNDVTKKHKKEALALVNNGWIWNADALRDNAGPDSRAYLRREVIVWGDCVKLRYGSCRDDNPFLWDFMTDYTRLMAKYFSGFRIDNCHSTPLVVAEYLLDEARKVRPNLTVFAELFTGSEEADYIFVKRLGINALIREAMQAWSTGELSRLVHRHGGRPIGSFDLDLPSSGSSHAIASSGLDSGKEKVVHIRPTPVQALFMDCTHDNEMPAQKRTAKDTLPNGALVAMCASAIGSVIGYDEVYPRLVDLVHEHRLYFSEFSEAPETGLNSLEGGIGGIKKLLNELHTKMGIEGYDETHIHHDGEYITVHRVHPRTRKGVFLIAHTAFPGQDSRSVLAPTHLVGTQVKHIGTWLLEVDTSQTTKERIQADKSYLRGLPSQVKTFEGTKIEESGKDTIISVLNSFVAGSIALFETSMPSVEHASGLDNYITEGVDHAFSDLSLVDLNFALYRCEAEERDSSKGQDGAYDIPGHGPLVYAGLQGWWSVLENIIKYNELGHPLCDHLRNGQWALDYIVARLEKLSHKEEHPALGRPAAWLQEKFQAVRQLPSFLLPRYFAIIVQVAYNAAWKRGIQLLGSHIQKGQEFIHQLGMVSVQQTGYVNSASLWPTKKVPSLAAGLPHFAVDWARCWGRDVFISLRGLLLCTGRFEDAKEHITAFASVLKHGMIPNLLSSGKLPRYNSRDSVWFFLQSIQDYTEMAPDGLEILDHKVPRRFLPYDDVWFPFDDPRAYSQQSTISEIIQEVFQRHAQGLSFREYNAGPDLDMQMTQDGFQIDVKVDWETGLIFGGSQYNCGTWQDKMGESAKAGNKGVPGTPRDGAAIEITGLVYSALTWVAKLHERGIYKHDGVDIGGGKSISFEDWASRIRANFERCYYVPLQPKDDGQYDIDANIINRRGIYKDLYRSGKPYEDYQLRSNFPIAMTVAPDLFTASKALAALALADEVLVGPVGMATLDPSDLNYRPNYNNSEDSTDFATAKGRNYHQGPEWVWQRGYFLRAFLHFDLARRTTPAERTETYQQITRRLEGCKRALRESPWKGLTELTNKNGAYCADSSPTQAWSAGCLLDLYYDASRHSQS

SEQ ID NO: 273 - protein, 656 aa, Artificial Sequence
  Transgucosidase EHA26552.1
MWSSWLLSALLATEALAVPYEEYILAPSSRDLAPASVRQVNGSVTNAAALTGAGGQATFNGVSSVTYDFGINVAGIVSVDVASASSESAFIGVTFTESSMWISSEACDATQDAGLDTPLWFAVGQGAGLYTVEKKYNRGAFRYMTVVSNTTATVSLNSVKINYTASPTQDLRAYTGYFHSNDELLNRIWYAGAYTLQLCSIDPTTGDALVGLGVITSSETISLPQTDKWWTNYTITNGSSTLTDGAKRDRLVWPGDMSIALESVAVSTEDLYSVRTALESLYALQKPDGRLPYAGKPFFDTVSFTYHLHSLVGAASYYQYTGDRAWLTRYWGQYKKGVQWALSSVDSTGLANITASADWLRFGMGAHNIEANAILYYVLNDAISLAQTLNDNAPIRNWTTTAARIKTVANELLWDDKNGLYTDNETTTLHPQDGNSWAVKANLTLSANQSAIVSESLAARWGPYGAPAPEAGATVSPFIGGFELQAHYQAGQPDRALDLLRLQWGFMLDDPRMTNSTFIEGYSTDGSLAYAPYTNTPRVSHAHGWATGPTSALTIYTAGLRVTGPAGATWLYKPQPGNLTQVEAGFSTRLGSFASSFSRSGGRYQELSFSTPNGTTGSVELGDVSGQLVSDRGVKVQLVGGKASGLQGGKWKLSNN

SEQ ID NO: 274 - protein, 790 aa, Artificial Sequence
  Transgucosidase EHA26885.1
MLGSLLLLLPLVGAAVIGPRANSQSCPGYKASNVQKQARSLTADLTLAGTPCNSYGKDLEDLKLLVEYQTDERLHVMIYDADEEVYQVPESVLPRVGSDEDSEDSVLEFDYVEEPFSFTISKGDEVLFDSSASPLVFQSQYVNLRTWLPDDPYVYGLGEHSDPMRLPTYNYTRTLWNRDAYGTPNNTNLYGSHPVYYDHRGKSGTYGVFLLNSNGMDIKINQTTDGKQYLEYNLLGGVLDFYFFYGEDPKQASMEYSKIVGLPAMQSYWTFGFHQCRYGYRDVYELAEVVYNYSQAKIPLETMWTDIDYMDKRRVFTLDPQRFPLEKMRELVTYLHNHDQHYIVMVDPAVSVSNNTAYITGVRDDVFLHNQNGSLYEGAVWPGVTVFPDWFNEGTQDYWTAQFQQFFDPKSGVDIDALWIDMNEASNFCPYPCLDPAAYAISADLPPAAPPVRPSSPIPLPGFPADFQPSSKRSVKRAQGDKGKKVGLPNRNLTDPPYTIRNAAGVLSMSTIETDLIHAGEGYAEYDTHNLYGTTHIPMVGADVCGFGSNTTEELCARWASLGAFYTFYRNHNELGDISQEFYRWPTVAESARKAIDIRYKLLDYIYTALHRQSQSGEPFLQPQFYLYPEDSNTFANDRQFFYGDALLVSPVLNEGSTSVDAYFPDDIFYDWYTGAVVRGHGENITLSNINITHIPLHIRGGNIIPVRTSSGMTTTEVRKQGFELIIAPDLDDTASGSLYLDDGDSLNPSSVTELEFTYSKGELHVKGTFGQKAVPKVEKCTLLGKSART

SEQ ID NO: 275 - protein, 562 aa, Artificial Sequence
  Transgucosidase EHA27488.1
MCHKSNYSSPKWWKESVVYQVYPASFNCGKSTTTTNGWGDVTGIIEKVPYLKSLGVDIVWLSPIYTSPQVDMGYDIADYKSIDPRYGTLADVDLLIKSLKDHDMRLMMDLVVNHTSDQHSWFVESASSKDSPKRDWYIWRPAKGFDEAGNPVPPNNWAQILGDTLSAWTWHEETQEFYLTLHTSAQAELNWENPDVVTAVYDVMEFWLRRGICGFRMDVINFISKDQSFPDAPIIDPASKYQPGEQFYTNGPRFHEFMHGIYDNVLSKYDTITVGETPYVTDMKEIIKTVGSTAKELNMAFNFDHMEIEDIKTKGESKWSLRDWKLTELKGILSGWQKRMREWDGWNAIFLECHDQARSVSRYTNDSDEFRDRGAKLLALLETTLGGTIFLYQGQEIGMRNFPVEWGPDTEYKDIESVNFWKKSKELHPVGSEGLAQARTLLQKKARDHARTPMQWSADPHAGFTVPDATPWMRVNDDYRTVNVEAQMSFPWEMKGELSVWQYWQQALQRRKLHKGAFVYGDFEDLDYHNESVFAYSRTSADGKETWLPVPSWSLPKKRTLS

SEQ ID NO: 276 - protein, 957 aa, Artificial Sequence; identical to SEQ ID NO: 233
  Transgucosidase EHA28539.1

SEQ ID NO: 277 - protein, 656 aa, Artificial Sequence; identical to SEQ ID NO: 177
  Transgucosidase XP_001389086.1

SEQ ID NO: 278 - protein, 587 aa, Artificial Sequence; identical to SEQ ID NO: 188
  Transgucosidase XP_001400455.1

SEQ ID NO: 279 - protein, 640 aa, Artificial Sequence; identical to SEQ ID NO: 167
  Transgucosidase XP_001390530.1

SEQ ID NO: 280 - protein, 957 aa, Artificial Sequence; identical to SEQ ID NO: 208
  Transgucosidase XP_001393899.1

SEQ ID NO: 281 - protein, 847 aa, Artificial Sequence; identical to SEQ ID NO: 230
  Transgucosidase XP_001399012.1

SEQ ID NO: 282 - protein, 985 aa, Artificial Sequence; identical to SEQ ID NO: 168
  Transgucosidase XP_001402053.1

SEQ ID NO: 283 - protein, 416 aa, Artificial Sequence
  Transgucosidase A2RAR6.1
MFVESAKKALLALSLLAASAQAVPRVRRQGASSSFDYKSQIVRGVNLGGWLVTEPWITPSLYDSTGGGAVDEWTLCQILGKDEAQAKLSSHWSSFITQSDFDRMAQAGLNHVRIPIGYWAVAPIDGEPYVSGQIDYLDQAVTWARAAGLKVLVDLHGAPGSQNGFDNSGHRGPIQWQQGDTVNQTMTAFDALARRYAQSDTVTAIEAVNEPNIPGGVNEDGLKNYYYGALADVQRLNPSTTLFMSDGFQPVESWNGFMQGSNVVMDTHHYQVFDTGLLSMSIDDHVKTACSLATQHTMQSDKPVVVGEWTGALTDCAKYLNGVGNAARYDGTYMSTTKYGDCTGKSTGSVADFSADEKANTRRYIEAQLEAYEMKSGWLFWTWKTEGAPGWDMQDLLANQLFPTSPTDRQYPHQCS

SEQ ID NO: 284 - protein, 830 aa, Artificial Sequence; identical to SEQ ID NO: 210
  Transgucosidase A2QX52.1

SEQ ID NO: 285 - protein, 2042 aa, Artificial Sequence
  Transgucosidase XP_001389036.2
MSSPQQVYLLPLKDDGSPDVPGGYIYLPAPTNPPYLLRFVIEGSSSICREGALWVNIPEKGESFNRSAFRSFSLSPDFNKNIQIDVPITSAGSFAFYVTFSPLPEFSVLSTPTPEPTRTPTHYIDVSPKLTLRGQDLPLNALSIYSVISKFMGQYPKEWEKHLNGISQRNYNMVHFTPLMKRGASNSPYSIFDQLQFDDAVFPNGEDDVARLISKMENEYGLLSLTDVVWNHTAHNSKWLEEHPEAGYSVETAPWLEAALELDTALLKFGQDLQNLGLPTEFQTVDELMKVMNVMRDKVIAGIRLWEFYAIDVKSDTHKILDKWKTSKDIDLTDTNWAQLNLQDYKNWTLKQQATFIRDHAIPTSKQVLGRFSRAVDLQFGAAILTALFGPHNPSTSDTSIVEESLSKILDEVNLPFYEEYDGDVSEIMNQVFNRIKYLRIDDHGPKLGAVTAQSPLIETYFTRLPLNDVTKKHKKEALALVNNGWIWNADALRDNAGPDSRAYLRREVIVWGDCVKLRYGSCRDDNPFLWDFMTDYTRLMAKYFSGFRIDNCHSTPLVVAEYLLDEARKVRPNLTVFAELFTGSEEADYIFVKRLGINALIREAMQAWSTGELSRLVHRHGGRPIGSFDLDLPSSGSSHAIASSGLDSGKEKVVHIRPTPVQALFMDCTHDNEMPAQKRTAKDTLPNGALVAMCASAIGSVIGYDEVYPRLVDLVHEHRLYFSEFSEAPETGLNSLEGGIGGIKKLLNELHTKMGIEGYDETHIHHDGEYITVHRVHPRTRKGVFLIAHTAFPGQDSRSVLAPTHLVGTQVKHIGTWLLEVDTSQTTKERIQADKSYLRGLPSQVKTFEGTKIEESGKDTIISVLNSFVAGSIALFETSMPSVEHASGLDNYITEGVDHAFSDLSLVDLNFALYRCEAEERDSSKGQDGAYDIPGHGPLVYAGLQGWWSVLENIIKYNELGHPLCDHLRNGQWALDYIVARLEKLSHKEEHPALGRPAAWLQEKFQAVRQLPSFLLPRYFAIIVQVAYNAAWKRGIQLLGPHIQKGQEFIHQLGMVSVQQTGYVNSASLWPTKKVPSLAAGLPHFAVDWARCWGRDVFISLRGLLLCTGRFEDAKEHITAFASVLKHGMIPNLLSSGKLPRYNSRDSVWFFLQSIQDYTEMAPDGLEILDHKVPRRFLPYDDVWFPFDDPRAYSQQSTISEIIQEVFQRHAQGLSFREYNAGPDLDMQMTQDGFQIDVKVDWETGLIFGGSQYNCGTWQDKMGESAKAGNKGVPGTPRDGAAIEITGLVYSALTWVAKLHERGIYKHDGVDIGGGKSISFEDWASRIRANFERCYYVPLQPKDDGQYDIDANIINRRGIYKDLYRSGKPYEDYQLRSNFPIAMTVAPDLFTASKALAALALADEVLVGPVGMATLDPSDLNYRPNYNNSEDSTDFATAKGRNYHQGPEWVWQRGYFLRAFLHFDLARRTTPAERTETYQQITRRLEGCKRALRESPWKGLTELTNKNGAYCADSSPTQAWSAGCLLDLYYDASRHSQMRIWYGPFKLRYKNIDAIDYYEEKLRRLDEKIQVARQKEYPPTEVAFVTMESIAASQMVVQAILDPHPMQLLARLAPAPADVVWKNTYLPRSRRMMQSWFITVVIGFLTVFWSVLLIPVAYLLEYETLHKVFPQLADALARNPLAKSLVQTGLPTLVLSLLTVAVPYLYNWLSNQQGMMSRGDIELSVISKTFFFSFFNLFLVFTVFGTATTFYGFWENLRDAFKDATTIAFALAKTLENFAPFYINFLCLQGIGLFPFRLLEFGSVAMYPINFLAAKTPRDYAELSTPPTFSYGYSIPQTVLSLIICVVYSVFPSSWLICLFGLIYFTIGKFIYKYQLLYAMDHQQHSTGRAWPMICSRILMGLMVFQLAMIGVLALRRAITRSLLIVPLLMATVWFSYFFARTYEPLMKFIALKSIDRERPGGGDISPSPSSTFSPPSGLDRDSFPIRIGGQELGLRLRKYVNPSLILPLHDAWLPGRTMVPELQGELEHRNPGNNAADESV

SEQ ID NO: 286 - protein, 866 aa, Artificial Sequence
  Transgucosidase XP_001389510.2
MLGSLLLLLPLVGAAVIGPRANSQSCPGYKASNVQKQARSLTADLTLAGTPCNSYGKDLEDLKLLVEYQTDERLHVMIYDADEEVYQVPESVLPRVGSDEDSEDSVLEFDYVEEPFSFTISKGDEVLFDSSASPLVFQSQYVNLRTWLPDDPYVYGLGEHSDPMRLPTYNYTRTLWNRDAYGTPNNTNLYGSHPVYYDHRGKSGTYGVFLLNSNGMDIKINQTTDGKQYLEYNLLGGVLDFYFFYGEDPKQASMEYSKIVGLPAMQSYWTFGFHQCRYGYRDVYELAEVVYNYSQAKIPLETMWTDIDYMDKRRVFTLDPQRFPLEKMRELVTYLHNHDQHYIVMVDPAVSVSNNTAYITGVRDDVFLHNQNGSLYEGAVWPGVTVFPDWFNEGTQDYWTAQFQQFFDPKSGVDIDALWIDMNEASNFCPYPCLDPAAYAISADLPPAAPPVRPSSPIPLPGFPADFQPSSKRSVKRAQGDKGKKVGLPNRNLTDPPYTIRNAAGVLSMSTIETDLIHAGEGYAEYDTHNLYGTMMSSASRTAMQARRPDVRPLVITRSTFAGAGAHVGHWLGDNFSDWVHYRISIAQILSFASMFQIPMVGADVCGFGSNTTEELCARWASLGAFYTFYRNHNELGDISQEFYRWPTVAESARKAIDIRYKLLDYIYTALHRQSQTGEPFLQPQFYLYPEDSNTFANDRQFFYGDALLVSPVLNEGSTSVDAYFPDDIFYDWYTGAVVRGHGENITLSNINITHIPLHIRGGNIIPVRTSSGMTTTEVRKQGFELIIAPDLDDTASGSLYLDDGDSLNPSSVTELEFTYSKGELHVKGTFGQKAVPKVEKCTLLGKSARTFKGFALDAPVNFKLK

SEQ ID NO: 287 - protein, 742 aa, Artificial Sequence
  Transgucosidase XP_001391128.2
MPSTYLGALATLAVFPCLGQARSTWPLGSGLELSYQASQHQISIHQDNQTIFSTIPGQPFLSASAGKDQFVEDSGNFNITNVNQARCRGQNITQLAGIPRSDSVKNQVAVRGYLLDCGGEDIAYGMNFWVPRRFSDRVAFEASVDSEANASFASMKNRSIPIFSREQGVGRGDQPYTAIEDSQGFFSGGDQYTTYTAIPQYVSSDGRVFYLDENDTAYAVFDFQRSDAVTVRYDSLSVHGHLMQADTMLDAITMLTEYTGRMPTLPEWVDHGALLGIQGGQEKVNRIVKQGFEHDCPVAGVWLQDWSGTHLQSAPYGNMNISRLWWNWESDTSLYPTWAEFVQTLREQHGVRTLAYVNPFLANVSSKSDGYRRNLFLEASQHRYMVQNTTTNSTAIISSGKGIDAGILDLTNEDTRAWFADVLRTQVWSANISGCMWDFGEYTPITPDTSLANISTSAFFYHNQYPRDWAAYQRSVAAEMPLFHEMVTFHRSASMGANRHMNLFWVGDQATLWTRNDGIKSVVTIQGQMGISGYAHSHSDIGGYTTVFEPPTTSNSSGAIPRSAELLGRWGELGAVSSAVFRSHEGNVPSVNAQFYSNSTTYAYFAYNARLFRSLGPYRRRILNTESQRRGWPLLRMPVLYHPEDLRARQISYESFFLGRDLYVAPVLDEGHKSVEVYFPGHSANRTYTHVWTGQTYRAGQTAKVSAPFGKPAVFLVDGASSPELDVFLDFVRKENGTVLYA

SEQ ID NO: 288 - protein, 680 aa, Artificial Sequence
  Transgucosidase XP_001395384.2
MDPANEYCGLEDYGLVGDMHTCALVSKNGSVDSMCWPVFDSPSIFCRILDKEKGGHFSITPDRRLKNPLSKQRYRPYTNMLETRWIHEEGVMNILDYFPIAKPKPHVVEKGLPQWCRCYQNKGSAQYQACRSGMVRKAECVRGEMEIEIELFPAFNYARDSHVAQQSSASDDAIQVYHFQAESQNLVVSVLGDRGDISGDDSDLSIEFELSDRPGHLGPGLVGKVTLKEGQSITMLLHDQESITCNVEDLAPYLQQIERTTGDFWSDWTSKCTFRGHYREQVERSLLVLKLLTYKPTGAIVAAPTFSLPEHIGGSRNWDYRYSWVRDAAFTVYVFLKNGYPEEAESYINFIFERIFPPMDKNPKPGEPFLPIMITIHGEREIPEMELEHLEGYRGSRPVRIGNGAATHIQLDIYGELMDSIYLYNKHAADISYDQWRAIRRMIDFVIQIRHQPDQSIWEVRGPPQNFVYSKIMLWVALDRGLRLAEKRSNLPCPDRARWMHERDALYDEIMTKGYNSEKGFFCMSYENQDAMDAAVLIAPLVFFVAPNDPRLLSTIQKITEVPAKGGLSVANMVSRYDTGKVDDGVGGNEGAFLMVTFWLVEAMMRAARSKAYLPHDPFFQQLRKTATSQFDSILSFANHLGMFSEEVATSGEQIGNMPQAFSHLACVSAAMNLGGGGDR

SEQ ID NO: 289 - protein, 601 aa, Artificial Sequence
  Transgucosidase XP_001396506.2
MCNKSNYSSPKWWKESVVYQVYPASFNCGKSTTNTNGWGDVTGIIEKVPYLESLGVDIVWLSPIYTSPQVDMGYDIADYESIDPRYGTLADVDLLIKTLKDHDMKLMMDLVVNHTSDQHSWFVESANSKDSPKRDWYIWRPAKGFDEAGNPVPPNNWAQILGDTLSAWTWHAETQEFYLTLHTSAQAELNWENPDVVTAVYDVMEFWLRRGICGFRMDVINFISKDQSFPDAPIIDPASKYQPGEQFYTNGPRFHEFMHGIYDNVLSKYDTITVGETPYVTDMKEIIKTVGSTAKELNMAFNFDHMEIEDIKTKGESKWSLRDWKLTELKGILSGWQKRMREWDGWNAIFLECHDQARSVSRYTNDSDEFRDRGAKLLALLETTLGGTIFLYQGQEIGMRNFPVEWDPDTEYKDIESVNFWKKSKELHPVGSEGLAQARTLLQKKARDHARTPMQWSADPHAGFTVPDATPWMRVNDDYGTVNVEAQMSFPWEMKGELSVWQYWQQALQRRKLHKGAFVYGDFEDLDYHNELVFAYSRTSADGKETWLVAMNWTTDAVEWTVPSGIHVTRWVSSTLQTAPLMAGQSTVTLRALEGVVGCCS

SEQ ID NO: 290 - protein, 704 aa, Artificial Sequence
  Transgucosidase XP_001398938.2
MGLCVGWRWILLCVVMGAAVCGTDKTATMRWHKLLPGVLALLPLSVAQSCWRNTTCSGPTESAFSGPWEKNIFAPSSRTVNPEKLFLITQPDKTEEYSPFALHGNGSLVVYDFGKEVGGIVSVNFSSTGSGALGVAFTEAKNWIGEWSDSSNGGFKGPDGALYGNFTEAGSHYYVMPDKSLRGGFRYLTLFLITSDNSTIQIEDVNLEIGFQPTWSNLKAYQGYFHSNDDLLNKIWYTGAYTLQTNEVPTDTGRQIPAMAVGWANNCTLGPGDTIIVDGAKRDRAVWPGDMGIAVPSAFVSLGDLDSVKNALQVMYDTQNNSTGAFDESGPPLSQKDSDTYHMWTMVGTYNYMLFTNDSDFLERNWEGYQKAMDYIYGKVTYPSGLLNVTGTRDWARWQQGYNNSEAQMILYHTLNTGAELATWAGDSGDLSSTWTSRAEKLRQAINEYCWDDSYGAFKDNATDTTLHPQDANSMALLFGVVDADRAASISERLTDNWTPIGAVAPELPENISPFISSFEIQGHLTVGQPQRALELIRRSWGWYYNNANGTQSTVIEGYLQNGTFGYRSDRGYYYDTAYVSHSHGWSSGPTSALTNYIVGISVTSPLGATWRIAPQFVDLQSAEGGFTTSLGKFQAGWSKTDKGYTLDFTVPHGTQGNLTLPFVSAAKPSIKIDGTEISRGVQYANSTATVTVSGGGTYKVEVQ

SEQ ID NO: 291 - skipped

SEQ ID NO: 292 - protein, 542 aa, Artificial Sequence; identical to SEQ ID NO: 102
  Betaglucosidase>tr|H9ZGE3|H9ZGE3_PRUDU Prunasin hydrolase OS=Prunus dulcis GN=Ph692 PE=2

SEQ ID NO: 293 - protein, 502 aa, Artificial Sequence
  UGT73-251_5
MDSPPQKPHFLLFPFMAQGHMIPMIDLAKLLAQRGAIITVVTTPHNAARYHSVLARAIDSGLHIHVLQLQFPCNEGGLPEGCENFDLLPSLGSASTFFRATFLLYEPSEKVFEELIPRPTCIISDMCLPWTVRLAQKYHVPRLVFYSLSCFFLLCMRSLKNNQALISSKSDSELVTFSDLPDPVEFLKSQLPKSNDEEMAKFGYEIGEADRQSHGVIVNVFEEMEPKYLAEYRKERESPEKVWCVGPVSLCNDNKLDKAQRGNKASIDERECIEWLDGQQPSSVVYVSLGSLCNLVTAQLIELGLGLEASNKPFIWVIRKGNITEELQKWLVEYDFEEKTKGRGLVILGWAPQVLILSHPAIGCFLTHCGWNSSIEGISAGMPMITWPLFADQVFNEKLIVEILRIGVSVGMETAMHWGEEEEKGVVVKREKVREAIERAMDGDEREERRERCKELAEMAKRAVEEGGSSHRNLTLLTEDILVNGGGQERMDDADDFPTIVN

SEQ ID NO: 294 - protein, 488 aa, Artificial Sequence
  UGT73-251-6
MDSPPHRPHFLLFPFMAQGHMIPMIDLAKLLAQRGAIVTILTTPHNAARTHSVLARAIDSGLQIRVRPLQFPCKEAGLPEGCENLDLLPSLGSASTFFRATCLLYDPSEKLFEELSPRPTCIISDMCLPWTIRLAQKYHVPRLVFYSLSCFFLLCMRSLKNNPALISSKSDSEFVTFSDLPDPVEFLKSELPKSTDEDLVKFSYEMGEADRKSYGVILNIFEEMEPKYLAEYGNERESPEKVWCVGPVSLCNDNKLDKAQRGNKASIDERECIKWLGGQQPSSVVYASLGSLCNLVTAQFIELGLGLEASNKPFIWVIRKGNITEELQKWLVEYDFEEKTKGRGLVILGWAPQVLILSHPSIGCFLTHCGWNSSIEGISAGVPMVTWPLFSDQVFNEKLIVQILRIGVSVGAETAMNWGEEEEKGVVVKREKVREAIERMMDGDEREERRERCKELAETAKRAIEEGGSSHRNLTLLIEDIGTSLRRL

SEQ ID NO: 295 - protein, 491 aa, Artificial Sequence
  UGT73-327-2
MGSAGVELKVAFLPFAAPGHMIPLMNIARLFAMHGADVTFITTPATASRFQNVVDSDLRRGHKIKLHTFQLPSAEAGLPPGVESFNECTSKEMTEKLFGAFEMLNGDIEQFLKGAKVDCIVSDTILVWTLDAAARLGIPRIAFRSSGFFSECIHHSLRCHKPHKKVGSDTEPFIFPGLPHKIEITRLNIPQWYSEEGYIQHIEKMKEMDKKSYAVLLNTFYELEADYVEYFESVIGLKTWIVGPVSLWANEGGGKNDSRTENNNAELMEWLDSKQPNSVLYVSFGSMTKFPSAQVLEIAHGLEDSGCHFIWVVRKMNESEAADEEFPEGFEERVRESKRGLIIRDWAPQELILNHAAVGGFVTHCGWNSILESVCAGRPIIAWPLSAEQFFNEKFVTRVLKVGVSIGVRKWWGSTSSETLDVVKRDRIAEAVARLMGDDREVVEMRDGVRELSHAAKRAIKEGGSSHSTLLSLIHELKTMKFKRQSSNVDG

SEQ ID NO: 296 - protein, 456 aa, Artificial Sequence
  UGT74-345-2
MDETTVNGGRRASDVVVFAFPRHGHMSPMLQFSKRLVSKGLRVTFLITTSATESLRLNLPPSSSLDLQVISDVPESNDIATLEGYLRSFKATVSKTLADFIDGIGNPPKFIVYDSVMPWVQEVARGRGLDAAPFFTQSSAVNHILNHVYGGSLSIPAPENTAVSLPSMPVLQAEDLPAFPDDPEVVMNFMTSQFSNFQDAKWIFFNTFDQLECKVVNWMADRWPIKTVGPTIPSAYLDDGRLEDDRAFGLNLLKPEDGKNTRQWQWLDSKDTASVLYISFGSLAILQEEQVKELAYFLKDTNLSFLWVLRDSELQKLPHNFVQETSHRGLVVNWCSQLQVLSHRAVSCFVTHCGWNSTLEALSLGVPMVAIPQWVDQTTNAKFVADVWRVGVRVKKKDERIVTKEELEASIRQVVQGEGRNEFKHNAIKWKKLAKEAVDEGGSSDKNIEEFVKTIA

SEQ ID NO: 297 - protein, 471 aa, Artificial Sequence
  UGT75-281-2
MMRNHHFLLVCFPSQGYINPSLQLARRLISLGVNVTFATTVLAGRRMKNKTHQTATTPGLSFATFSDGFDDETLKPNGDLTHYFSELRRCGSESLTHLITSAANEGRPITFVIYSLLLSWAADIASTYDIPSALFFAQPATVLALYFYYFHGYGDTICSKLQDPSSYIELPGLPLLTSQDMPSFFSPSGPHAFILPPMREQAEFLGRQSQPKVLVNTFDALEADALRAIDKLKMLAIGPLIPSALLGGNDSSDASFCGDLFQVSSEDYIEWLNSKPDSSVVYISVGSICVLSDEQEDELVHALLNSGHTFLWVKRSKENNEGVKQETDEEKLKKLEEQGKMVSWCRQVEVLKHPALGCFLTHCGWNSTIESLVSGLPVVAFPQQIDQATNAKLIEDVWKTGVRVKANTEGIVEREEIRRCLDLVMGSRDGQKEEIERNAKKWKELARQAIGEGGSSDSNLKTFLWEIDLEI

SEQ ID NO: 298 - protein, 471 aa, Artificial Sequence; identical to SEQ ID NO: 297
  UGT75-281-2

SEQ ID NO: 299 - protein, 485 aa, Artificial Sequence
  UGT85-269-4
MAEQAHDLLHVLLFPFPAEGHIKPFLCLAELLCNAGFHVTFLNTDYNHRRLHNLHLLAARFPSLHFESISDGLPPDQPRDILDPKFFISICQVTKPLFRELLLSYKRISSVQTGRPPITCVITDVIFRFPIDVAEELDIPVFSFCTFSARFMFLYFWIPKLIEDGQLPYPNGNINQKLYGVAPEAEGLLRCKDLPGHWAFADELKDDQLNFVDQTTASSRSSGLILNTFDDLEAPFLGRLSTIFKKIYAVGPIHSLLNSHHCGLWKEDHSCLAWLDSRAAKSVVFVSFGSLVKITSRQLMEFWHGLLNSGKSFLFVLRSDVVEGDDEKQVVKEIYETKAEGKWLVVGWAPQEKVLAHEAVGGFLTHSGWNSILESIAAGVPMISCPKIGDQSSNCTWISKVWKIGLEMEDRYDRVSVETMVRSIMEQEGEKMQKTIAELAKQAKYKVSKDGTSYQNLECLIQDIKKLNQIEGFINNPNFSDLLRV

SEQ ID NO: 300 - protein, 419 aa, Artificial Sequence; identical to SEQ ID NO: 128
  UGT85-269-1

SEQ ID NO: 301 - protein, 453 aa, Artificial Sequence; identical to SEQ ID NO: 125
  UGT94-289-1

SEQ ID NO: 302 - protein, 459 aa, Artificial Sequence
  UGT94-289-2
MDAQQGHTTTILMLPWVGYGHLLPFLELAKSLSRRKLFHIYFCSTSVSLDAIKPKLPPSISSDDSIQLVELRLPSSPELPPHLHTTNGLPSHLMPALHQAFVMAAQHFQVILQTLAPHLLIYDILQPWAPQVASSLNIPAINFSTTGASMLSRTLHPTHYPSSKFPISEFVLHNHWRAMYTTADGALTEEGHKIEETLANCLHTSCGVVLVNSFRELETKYIDYLSVLLNKKVVPVGPLVYEPNQEGEDEGYSSIKNWLDKKEPSSTVFVSFGTEYFPSKEEMEEIAYGLELSEVNFIWVLRFPQGDSTSTIEDALPKGFLERAGERAMVVKGWAPQAKILKHWSTGGLVSHCGWNSMMEGMMFGVPIIAVPMHLDQPFNAGLVEEAGVGVEAKRDSDGKIQREEVAKSIKEVVIEKTREDVRKKAREMGEILRSKGDEKIDELVAEISLLRKKAPCSI

SEQ ID NO: 303 - protein, 452 aa, Artificial Sequence; identical to SEQ ID NO: 129
  UGT94-289-3

SEQ ID NO: 304 - protein, 469 aa, Artificial Sequence
  330
MDTRKRSIRILMFPWLAHGHISAFLELAKSLAKRNFVIYICSSQVNLNSISKNMSSKDSISVKLVELHIPTTILPPPYHTTNGLPPHLMSTLKRALDSARPAFSTLLQTLKPDLVLYDFLQSWASEEAESQNIPAMVFLSTGAAAISFIMYHWFETRPEEYPFPAIYFREHEYDNFCRFKSSDSGTSDQLRVSDCVKRSHDLVLIKTFRELEGQYVDFLSDLTRKRFVPVGPLVQEVGCDMENEGNDIIEWLDGKDRRSTVFSSFGSEYFLSANEIEEIAYGLELSGLNFIWVVRFPHGDEKIKIEEKLPEGFLERVEGRGLVVEGWAQQRRILSHPSVGGFLSHCGWSSVMEGVYSGVPIIAVPMHLDQPFNARLVEAVGFGEEVVRSRQGNLDRGEVARVVKKLVMGKSGEGLRRRVEELSEKMREKGEEEIDSLVEELVTVVRRRERSNLKSENSMKKLNVMDDGE

SEQ ID NO: 305 - DNA, 1410 bp, Artificial Sequence
  330
atggatacaagaaagagaagcatcaggattctaatgttcccatggcttgctcatggccatatctcagcattcctcgagctggcgaagtcacttgccaaaagaaacttcgtcatttacatttgttcttcacaagtaaatctaaattccatcagcaagaacatgtcatcaaaagactccatttccgtaaaacttgttgagcttcacattcccaccaccatacttccccctccttaccacaccaccaatggcctcccaccccacctcatgtccaccctcaagagagccctcgacagtgcccggcccgccttctccaccctcctccaaaccctcaagcccgacttggttttatacgatttcctccagtcgtgggcctcggaggaggccgagtcgcagaatataccagccatggtgtttctgagtaccggagctgcagcgatttcttttattatgtaccattggtttgagaccagaccggaggagtacccttttccggctatatacttccgggaacacgagtatgataacttctgccgttttaagtcttccgacagcggtactagtgatcaattgagagtcagcgattgcgttaaacggtcgcacgatttggttctgatcaagacattccgtgaactggaaggacaatacgtagattttctctccgacttgactcggaagagattcgtaccagttggcccccttgttcaggaggtaggttgtgatatggagaatgaaggaaatgacatcatcgaatggctcgacgggaaagaccgtcgttcgacggttttctcctcattcgggagcgagtacttcttgtctgccaatgagatcgaagagatagcttatgggctggagctaagcgggcttaacttcatctgggttgttaggtttcctcatggcgacgagaaaatcaagattgaggagaaactgccggaagggtttcttgagagagtggaaggaagagggttggtggtggagggatgggcacagcagaggagaatattgtcacatccgagtgttggagggtttttgagccactgtgggtggagttctgtgatggaaggggtgtattccggtgtgccgattattgccgtgccgatgcatcttgaccagccgttcaatgctaggttggtggaggcggtggggtttggggaggaggtggtgaggagtagacaaggaaatcttgacagaggagaggtggcgagggtggtgaagaagctggttatggggaaaagtggggaggggttacggcggagggtggaggagttgagtgagaagatgagagagaaaggggaggaggagattgattcactggtggaggaattggtgacggtggttaggaggagagagagatcgaatctcaagtctgagaattctatgaagaaattgaatgtgatggatgatggagaatag

SEQ ID NO: 306 - protein, 469 aa, Artificial Sequence
  UGT98 Native host S. grosvenorii
MDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFNTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDSDGKIQREEVAKSIKEVVIEKTREDVRKKAREMGEILRSKGDEKIDELVAEISLLRKKAPCSIAAALEHHHHHH

SEQ ID NO: 307 - DNA, 1419 bp, Artificial Sequence
  UGT98 Native host S. grosvenorii
ctcgaattcatggatgcccagcgaggtcacaccacaaccattttgatgtttccatggctcggctatggccatctttcggctttcctagagttggccaaaagcctctcaaggaggaacttccatatctacttctgttcaacctctgttaacctcgacgccattaaaccaaagcttccttcttcttcctcttctgattccatccaacttgtggaactttgtcttccatcttctcctgatcagctccctcctcatcttcacacaaccaacgccctcccccctcacctcatgcccactctccaccaagccttctccatggctgcccaacactttgctgccattttacacacacttgctccgcatctcctcatttacgactctttccaaccttgggctcctcaactagcttcatccctcaacattccagccatcaacttcaatactacgggagcttcagtcctgacccgaatgcttcacgctactcactacccaagttctaaattcccaatttcagagtttgttctccacgattattggaaagccatgtacagcgccgccggtggggctgttacaaaaaaagaccacaaaattggagaaacacttgcgaattgcttgcatgcttcttgtagtgtaattctaatcaatagtttcagagagctcgaggagaaatatatggattatctctccgttctcttgaacaagaaagttgttccggttggtcctttggtttacgaaccgaatcaagacggggaagatgaaggttattcaagcatcaaaaattggcttgacaaaaaggaaccgtcctccaccgtcttcgtttcatttggaagcgaatacttcccgtcaaaggaagaaatggaagagatagcccatgggttagaggcgagcgaggttcatttcatctgggtcgttaggtttcctcaaggagacaacaccagcgccattgaagatgccttgccgaaggggtttctggagagggtgggagagagagggatggtggtgaagggttgggctccccaggcgaagatactgaagcattggagcacagggggattcgtgagccactgtggatggaactcggtgatggaaagcatgatgtttggcgttcccataataggggttccgatgcatctggaccagccctttaacgccggactcgcggaagaagctggcgtcggcgtggaagccaagcgagattcggacggcaaaattcaaagagaagaagttgcaaagtcgatcaaagaagtggtgattgagaaaaccagggaagacgtgaggaagaaagcaagagaaatgggtgagattttgaggagtaaaggagatgagaaaattgatgagttggtggctgaaatttctcttttgcgcaaaaaggccccatgttcaattgcggccgcactcgagcaccaccaccaccaccactga

SEQ ID NO: 308 - protein, 520 aa, Artificial Sequence
  CYP 1798
MEMSSSVAATISIWMVVVCIVGVGWRVVNWVWLRPKKLEKRLREQGLAGNSYRLLFGDLKERAAMEEQANSKPINFSHDIGPRVFPSMYKTIQNYGKNSYMWLGPYPRVHIMDPQQLKTVFTLVYDIQKPNLNPLIKFLLDGIVTHEGEKWAKHRKIINPAFHLEKLKDMIPAFFHSCNEIVNEWERLISKEGSCELDVMPYLQNLAADAISRTAFGSSYEEGKMIFQLLKELTDLVVKVAFGVYIPGWRFLPTKSNNKMKEINRKIKSLLLGIINKRQKANMEEGEAGQSDLLGILMESNSNEIQGEGNNKEDGMSIEDVIEECKVFYIGGQETTARLLIWTMILLSSHTEWQERARTEVLKVFGNKKPDFDGLSRLKVVTMILNEVLRLYPPASMLTRIIQKETRVGKLTLPAGVILIMPIILIHRDHDLWGEDANEFKPERFSKGVSKAAKVQPAFFPFGWGRICMGQNFAMIEAKMALSLILQRFSFELSSSYVHAPTVVFTTQPQHGAHIVLRKL

SEQ ID NO: 309 - protein, 316 aa, Artificial Sequence
  Epoxide hydrolase
MDAIEHRTVSVNGINSHVAEKGEGPVVLLLHGFPELWYSWRHQILALSSLGYRAVAPDLRGYGDTDAPGSISSYTCFHIVGDLVALVESLGMDRVFVVAHDWGAMIAWCLCLFRPEMVKAFVCLSVPFRQRNPKMKPVQSMRAFFGDDYYICRFQNPGEIEEEMAQVGAREVLRGILTSRRPGPPILPKGQAFRARPGASTALPSWLSEKDLSFFASKYDQKGFTGPLNYYRAMDLNWELTASWTGVQVKVPVKYIVGDVDMVFTTPGVKEYVNGGGFKKDVPFLQEVVIMEGVGHFINQEKQEISSHIMDFISKF

SEQ ID NO: 310 - protein, 316 aa, Artificial Sequence
  Epoxide hydrolase
MDEIEHITINTNGIKMHIASVGTGPVVLLLHGFPELWYSWRHQLLYLSSVGYRAIAPDLRGYGDTDSPASPTSYTALHIVGDLVGALDELGIEKVFLVGHDWGAIIAWYFCLFRPDRIKALVNLSVQFIPRNPAIPFIEGFRTAFGDDFYICRFQVPGEAEEDFASIDTAQLFKTSLCNRSSAPPCLPKEIGFRAIPPPENLPSWLTEEDINFYAAKFKQTGFTGALNYYRAFDLTWELTAPWTGAQIQVPVKFIVGDSDLTYHFPGAKEYIHNGGFKRDVPLLEEVVVVKDACHFFNQERPQEINAHIHDFINKF

SEQ ID NO: 311 - protein, 316 aa, Artificial Sequence; identical to SEQ ID NO: 24
  Epoxide hydrolase

SEQ ID NO: 312 - protein, 316 aa, Artificial Sequence
  Epoxide hydrolase
MDQIEHITINTNGIKMHIASVGTGPVVLLLHGFPELWYSWRHQLLYLSSVGYRAIAPDLRGYGDTDSPASPTSYTALHIVGDLVGALDELGIEKVFLVGHDWAAIIAWYFCLFRPDRIKALVNLSVQFIPRNPAIPFIEGFRTAFGDDFYMCRFQVPGEAEEDFASIDTAQLFKTSLCNRSSAPPCLPKEIGFRAIPPPENLPSWLTEEDINYYAAKFKQTGFTGALNYYRAFDLTWELTAPWTGAQIQVPVKFIVGDSDLTYHFPGAKEYIHNGGFKKDVPLLEEVVVVKDACHFINQERPQEINAHIHDFINKF

SEQ ID NO: 313 - protein, 314 aa, Artificial Sequence
  Epoxide hydrolase
MEKIEHSTIATNGINMHVASAGSGPAVLFLHGFPELWYSWRHQLLYLSSLGYRAIAPDLRGFGDTDAPPSPSSYTAHHIVGDLVGLLDQLGVDQVFLVGHDWGAMMAWYFCLFRPDRVKALVNLSVHFTPRNPAISPLDGFRLMLGDDFYVCKFQEPGVAEADFGSVDTATMFKKFLTMRDPRPPIIPNGFRSLATPEALPSWLTEEDIDYFAAKFAKTGFTGGFNYYRAIDLTWELTAPWSGSEIKVPTKFIVGDLDLVYHFPGVKEYIHGGGFKKDVPFLEEVVVMEGAAHFINQEKADEINSLIYDFIKQF

SEQ ID NO: 314 - protein, 316 aa, Artificial Sequence; identical to SEQ ID NO: 22
  Epoxide hydrolase

SEQ ID NO: 315 - protein, 473 aa, Artificial Sequence; identical to SEQ ID NO: 49
  CYP87D18

SEQ ID NO: 316 - DNA, 1422 bp, Artificial Sequence; identical to SEQ ID NO: 42
  CYP87D18

SEQ ID NO: 317 - protein, 688 aa, Artificial Sequence
  AtCPR
MTSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 318 - DNA, 2067 bp, Artificial Sequence
  AtCPR
atgacttctgctttgtatgcttccgatttgtttaagcagctcaagtcaattatggggacagattcgttatccgacgatgttgtacttgtgattgcaacgacgtctttggcactagtagctggatttgtggtgttgttatggaagaaaacgacggcggatcggagcggggagctgaagcctttgatgatccctaagtctcttatggctaaggacgaggatgatgatttggatttgggatccgggaagactagagtctctatcttcttcggtacgcagactggaacagctgagggatttgctaaggcattatccgaagaaatcaaagcgagatatgaaaaagcagcagtcaaagatgactatgctgccgatgatgaccagtatgaagagaaattgaagaaggaaactttggcatttttctgtgttgctacttatggagatggagagcctactgacaatgctgccagattttacaaatggtttacggaggaaaatgaacgggatataaagcttcaacaactagcatatggtgtgtttgctcttggtaatcgccaatatgaacattttaataagatcgggatagttcttgatgaagagttatgtaagaaaggtgcaaagcgtcttattgaagtcggtctaggagatgatgatcagagcattgaggatgattttaatgcctggaaagaatcactatggtctgagctagacaagctcctcaaagacgaggatgataaaagtgtggcaactccttatacagctgttattcctgaataccgggtggtgactcatgatcctcggtttacaactcaaaaatcaatggaatcaaatgtggccaatggaaatactactattgacattcatcatccctgcagagttgatgttgctgtgcagaaggagcttcacacacatgaatctgatcggtcttgcattcatctcgagttcgacatatccaggacgggtattacatatgaaacaggtgaccatgtaggtgtatatgctgaaaatcatgttgaaatagttgaagaagctggaaaattgcttggccactctttagatttagtattttccatacatgctgacaaggaagatggctccccattggaaagcgcagtgccgcctcctttccctggtccatgcacacttgggactggtttggcaagatacgcagaccttttgaaccctcctcgaaagtctgcgttagttgccttggcggcctatgccactgaaccaagtgaagccgagaaacttaagcacctgacatcacctgatggaaaggatgagtactcacaatggattgttgcaagtcagagaagtcttttagaggtgatggctgcttttccatctgcaaaacccccactaggtgtattttttgctgcaatagctcctcgtctacaacctcgttactactccatctcatcctcgccaagattggcgccaagtagagttcatgttacatccgcactagtatatggtccaactcctactggtagaatccacaagggtgtgtgttctacgtggatgaagaatgcagttcctgcggagaaaagtcatgaatgtagtggagccccaatctttattcgagcatctaatttcaagttaccatccaacccttcaactccaatcgttatggtgggacctgggactgggctggcaccttttagaggttttctgcaggaaaggatggcactaaaagaagatggagaagaactaggttcatctttgctcttctttgggtgtagaaatcgacagatggactttatatacgaggatgagctcaataattttgttgatcaaggcgtaatatctgagctcatcatggcattctcccgtgaaggagctcagaaggagtatgttcaacataagatgatggagaaggcagcacaagtttgggatctaataaaggaagaaggatatctctatgtatgcggtgatgctaagggcatggcgagggacgtccaccgaactctacacaccattgttcaggagcaggaaggtgtgagttcgtcagaggcagaggctatagttaagaaacttcaaaccgaaggaagatacctcagagatgtctggtga

SEQ ID NO: 319 - protein, 759 aa, Artificial Sequence; identical to SEQ ID NO: 70
  Cucurbitadienol synthase Native host S. grosvernorii Seq 59 SgCbQ

SEQ ID NO: 320 - DNA, 2280 bp, Artificial Sequence
  Cucurbitadienol synthase SgCbQ
atgtggaggttaaaggtcggagcagaaagcgttggggagaatgatgagaaatggttgaagagcataagcaatcacttgggacgccaggtgtgggagttctgtccggatgccggcacccaacaacagctcttgcaagtccacaaagctcgtaaagctttccacgatgaccgtttccaccgaaagcaatcttccgatctctttatcactattcagtatggaaaggaagtagaaaatggtggaaagacagcgggagtgaaattgaaagaaggggaagaggtgaggaaagaggcagtagagagtagcttagagagggcattaagtttctactcaagcatccagacaagcgatgggaactgggcttcggatcttggggggcccatgtttttacttccgggtctggtgattgccctctacgttacaggcgtcttgaattctgttttatccaagcaccaccggcaagagatgtgcagatatgtttacaatcaccagaatgaagatggggggtggggtctccacatcgagggcccaagcaccatgtttggttccgcactgaattatgttgcactcaggctgcttggagaagacgccaacgccggggcaatgccaaaagcacgtgcttggatcttggaccacggtggcgccaccggaatcacttcctggggcaaattgtggctttctgtacttggagtctacgaatggagtggcaataatcctcttccacccgaattttggttatttccttacttcctaccatttcatccaggaagaatgtggtgccattgtcgaatggtttatctaccaatgtcatacttatatggaaagagatttgttgggccaatcacacccatagttctgtctctcagaaaagaactctacgcagttccatatcatgaaatagactggaataaatctcgcaatacatgtgcaaaggaggatctgtactatccacatcccaagatgcaagatattctgtggggatctctccaccacgtgtatgagcccttgtttactcgttggcctgccaaacgcctgagagaaaaggctttgcagactgcaatgcaacatattcactatgaagatgagaatacccgatatatatgccttggccctgtcaacaaggtactcaatctgctttgttgttgggttgaagatccctactccgacgccttcaaacttcatcttcaacgagtccatgactatctctgggttgctgaagatggcatgaaaatgcagggttataatgggagccagttgtgggacactgctttctccatccaagcaatcgtatccaccaaacttgtagacaactatggcccaaccttaagaaaggcacacgacttcgttaaaagttctcagattcagcaggactgtcctggggatcctaatgtttggtaccgtcacattcataaaggtgcatggccattttcaactcgagatcatggatggctcatctctgactgtacagcagagggattaaaggctgctttgatgttatccaaacttccatccgaaacagttggggaatcattagaacggaatcgcctttgcgatgctgtaaacgttctcctttctttgcaaaacgataatggtggctttgcatcatatgagttgacaagatcatacccttggttggagttgatcaaccccgcagaaacgtttggagatattgtcattgattatccgtatgtggagtgcacctcagccacaatggaagcactgacgttgtttaagaaattacatcccggccataggaccaaagaaattgatactgctattgtcagggcggccaacttccttgaaaatatgcaaaggacggatggctcttggtatggatgttggggggtttgcttcacgtatgcggggtggtttggcataaagggattggtggctgcaggaaggacatataataattgccttgccattcgcaaggcttgcgattttttactatctaaagagctgcccggcggtggatggggagagagttacctttcatgtcagaataaggtatacacaaatcttgaaggaaacagaccgcacctggttaacacggcctgggttttaatggccctcatagaagctggccaggctgagagagacccaacaccattgcatcgtgcagcaaggttgttaatcaattcccagttggagaatggtgatttcccccaacaggagatcatgggagtctttaataaaaattgcatgatcacatatgctgcataccgaaacatttttcccatttgggctcttggagagtattgccatcgggttttgactgaataa

SEQ ID NO: 321 - protein, 766 aa, Artificial Sequence
  Cucurbitadienol synthase Cpep2
MWRLKVGAESVGEKDEKWVKSVSNHLGRQVWEFCAADAAAVTPHQLLQIQNARNHFHRNRFHRKQSSDLFLAIQYEKEIAKGGKGKEAVKVKEGEEVGKEAVKSTLERALSFYTAVQTSDGNWASDLGGPMFLLPGLVIALYVTGVLNSVLSKHHRVEMCRYIYNHQNEDGGWGLHIEGTSTMFGSALNYVALRLLGEDADGGDDGAMTKARAWILERGGATAITSWGKLWLSVLGVYEWSGNNPLPPEFWLLPYSLPFHPGRMWCHCRMVYLPMSYLYGKRFVGPITPKVLSLRQELYTVPYHEIDWNKSRNTCAKEDLYYPHPKMQDILWGSIYHVYEPLFTRWPGKRLREKALQTAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPFSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRGARLVMNSQLENGDFVQQEIMGVFNKNCMITYAAYRNIFPIWALGEYCHRVLTE

SEQ ID NO: 322 - DNA, 2301 bp, Artificial Sequence
  Cucurbitadienol synthase Cpep2
atgtggaggctgaaggtgggagcagagagcgttggggagaaggatgagaaatgggtgaagagcgtaagcaatcacttgggccgccaagtttgggagttctgtgccgccgacgccgccgccgtcactcctcaccagttactacaaattcagaatgctcgcaaccacttccatcgcaatcgtttccaccggaagcagtcttccgatctctttctcgctattcagtatgaaaaggaaatagcgaagggcggaaaagggaaagaggcggtgaaagtgaaagaaggggaggaggtggggaaagaggcggtgaagagtacgttagagagggcactaagtttctacacagccgtgcagacgagcgatgggaattgggcctcggatcttggagggcccatgtttttacttccgggtctcgtgattgccctttatgtcacaggcgtgttgaattcagttttgtccaagcaccaccgcgtagagatgtgcagatatatttacaatcaccagaatgaagatggagggtggggtctacatattgagggcacaagcaccatgtttggttcggcactcaattatgttgcacttaggctgcttggagaagacgccgatggcggagacgatggtgcaatgacaaaagcacgtgcttggatcttggagcgcggcggcgccactgcgatcacttcgtggggaaaattgtggctgtccgtgcttggagtgtacgaatggagtggcaacaaccctcttccgcctgagttttggcttctcccttacagcctaccatttcatccaggacgaatgtggtgccattgtcgaatggtttatcttcccatgtcttacttatatgggaagagatttgttggcccaatcactcccaaagttctttctctaagacaagagctctacacggttccttatcatgaaatagactggaataaatcccgcaatacatgtgcaaaggaggatctatactatccacatcccaagatgcaagacatactatggggatctatctaccatgtatatgagccattgttcactcgttggcctgggaaacgcctgagggaaaaggctttacaaactgcaatgaaacatattcactatgaagatgaaaatagtcgctatatatgtcttggcccagtcaacaaggtactcaacatgctttgttgttgggttgaagatccctactcagacgccttcaaacttcaccttcaacgcgtccatgactatctctgggttgctgaagatggcatgagaatgcagggttacaatggcagccagttgtgggacactgctttctccatccaagccattgtagctaccaaacttgtagacagctatgccccaactttaagaaaagcacatgactttgttaaggattctcagatccaggaggactgtcctggggatcctaatgtttggttccgtcatattcataaaggtgcttggccattttcgactcgagatcatggatggctcatctctgactgcacggctgagggattgaaggcttctttgatgttatccaaacttccatccacaatggttggggagccattagaaaagaatcgcctttgtgatgctgttaatgttctcctttctttgcaaaatgataacggtggatttgcatcatacgagttgacgagatcatacccttggttggagttgatcaacccagcagaaacattcggagacattgtcatcgactatccgtatgtggagtgcaccgcagcaacaatggaagcactgacgttatttaagaagctacatccaggccataggaccaaagagattgacacagctattggcaaggcagccaacttccttgagaaaatgcaaagggcggatggctcttggtatgggtgttggggggtttgtttcacgtatgcggggtggtttggcatcaagggattggtggctgcaggaagaacatataatagctgccttgccatccgcaaggcttgtgagtttctgctatctaaagagctgcccggcggtggatggggggagagttacctttcatgtcagaataaggtgtacaccaatcttgagggaaacaagccacacttggttaacactgcctgggttttaatggctctcattgaagccggccagggtgagagagacccagcaccattgcaccgtggagcaaggttggtaatgaattctcaactggagaatggtgatttcgtgcaacaggagatcatgggagtgttcaataagaactgcatgatcacatatgctgcataccgaaacatcttccccatttgggcgcttggagagtattgccatcgggttcttactgaatga

SEQ ID NO: 323 - protein, 766 aa, Artificial Sequence
  Cucurbitadienol synthase Cpep4
MWRLKVGAESVGEKDEKWVKSVSNHLGRQVWEFCAADAAAVTPHQLLQIQNARNHFHRNRFHRKQSSDLFLAIQYEKEIAKGGKGKEAVKVKEGEEVGKEAVKSTLERALSFYTAVQTSDGNWASDLGGPMFLLPGLVIALYVTGVLNSVLSKHHRVEMCRYIYNHQNEDGGWGLHIEGTSTMFGSALNYVALRLLGEDADGGDDGAMTKARAWILERGGATAITSWGKLWLSVLGVYEWSGNNPLPPEFLLLPYSLPFHPGRMWCHCRMVYLPMSYLYGKRFVGPITPKVLSLRQELYTVPYHEIDWNKSRNTCAKEDLYYPHPKMQDILWGSIYHVYEPLFTRWPGKRLREKALQTAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPFSTRDHGWLISDCTAEGLKASLMLSKLPSTMVGEPLEKNRLCDAVNVLLSLQNDNGGFASYELTRSYPWLELINPAETFGDIVIDYSYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLVMNSQLENGDFVQQEIMGVFNKNCMITYAAYRNIFPIWALGEYCHRVLTE

SEQ ID NO: 324 - DNA, 2301 bp, Artificial Sequence
  Cucurbitadienol synthase Cpep4
atgtggaggctgaaggtgggagcagagagcgttggggagaaggatgagaaatgggtgaagagcgtaagcaatcacttgggccgccaagtttgggagttctgtgccgccgacgccgccgccgtcactcctcaccagttactacaaattcagaatgctcgcaaccacttccatcgcaatcgtttccaccggaagcagtcttccgatctctttctcgctattcagtatgaaaaggaaatagcgaagggcggaaaagggaaagaggcggtgaaagtgaaagaaggggaggaggtggggaaagaggcggtgaagagtacgttagagagggcactaagtttctacacagccgtgcagacgagcgatgggaattgggcctcggatcttggagggcccatgtttttacttccgggtctcgtgattgccctttatgtcacaggcgtgttgaattcagttttgtccaagcaccaccgcgtagagatgtgcagatatatttacaatcaccagaatgaagatggagggtggggtctacatattgagggcacaagcaccatgtttggttcggcactcaattatgttgcacttaggctgcttggagaagacgccgatggcggagacgatggtgcaatgacaaaagcacgtgcttggatcttggagcgcggcggcgccactgcgatcacttcgtggggaaaattgtggctgtccgtgcttggagtgtacgaatggagtggcaacaaccctcttccgcctgagtttttgcttctcccttacagcctaccatttcatccaggacgaatgtggtgccattgtcgaatggtttatcttcccatgtcttacttatatgggaagagatctgttcgcccaatcactcccaaagttctttctctaagacaagagctctacacggttccttatcatgaaatagactggaataaatcccgcaatacatgtgcaaaggaggatctatactatccacatcccaagatgcaagacatactatggggatctatctaccatgtatatgagccattgttcactcgttggcctgggaaacgcctgagggaaaaggctttacaaactgcaatgaaacatattcactatgaagatgaaaatagtcgctatatatgtcttggcccagtcaacaaggtactcaacatgctttgttgttgggttgaagatccctactcagacgccttcaaacttcaccttcaacgcgtccatgactatctctgggttgctgaagatggcatgagaatgcagggttacaatggcagccagttgtgggacactgctttctccatccaagccattgtagctaccaaacttgtagacagctatgccccaactttaagaaaagcacatgactttgttaaggattctcagatccaggaggactgtcctggggatcctaatgtttggttccgtcatattcataaaggtgcttggccattttcgactcgagatcatggatggctcatctctgactgcacggctgagggattgaaggcttctttgatgttatccaaacttccatccacaatggttggggagccattagaaaagaatcgcctttgtgatgctgttaatgttctcctttctttgcaaaatgataacggcggatttgcatcatacgagttgacgagatcatacccttggttggagttgatcaacccagcagaaacattcggagacattgtcatcgactattcgtatgtggagtgcaccgcagcaacaatggaagcactgacgttatttaagaagctacatccaggccataggaccaaagagattgacacagctattggcaaggcagccaacttccttgagaaaatgcaaagggcggatggctcttggtatgggtgttggggggtttgtttcacgtatgcggggtggtttggcataaagggattggtggctgcaggaagaacatataatagctgtcttgccatccgcaaggcttgtgagtttctgctatctaaagagctgcccggcggtggatggggggagagttacctttcatgtcagaataaggtgtacaccaatcttgagggaaacaagccacacttggttaacactgcctgggttttaatggctctcattgaagctggccagggtgagagagacccagcaccattgcaccgtgcagcaaggttggtaatgaattctcaactggagaatggcgatttcgtgcaacaggagatcatgggagtgttcaataagaactgcatgatcacatatgctgcataccgaaacatcttccccatttgggcgcttggagagtattgccatcgggttcttactgaatga

SEQ ID NO: 325 - protein, 764 aa, Artificial Sequence
  Cucurbitadienol synthase Cmax1
MWRLKVGAESVGEKDEKWVKSVSNHLGRQVWEFCADAAADTPHQLLQIQNARNHFHHNRFHRKQSSDLFLAIQYEKEIAKGAKGGAVKVKEGEEVGKEAVKSTLESALGFYSAVQTSDGNWASDLGGPMFLLPGLVIALHVTGVLNSVLSKHHRVEMCRYLYNHQNEDGGWGLHIEGTSTMFGSALNYVALRLLGEDADGGDGGAMTKARAWILERGGATAITSWGKLWLSVLGVYEWSGNNPLPPEFWLLPYSLPFHPGRMWCHCRMVYLPMSYLYGKRFVGPITPKVLSLRQELYTIPYHEIDWNKSRNTCAKEDLYYPHPKMQDILWGSIYHVYEPLFTRWPGKRLREKALQAAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPFSTRDHGWLISDCTAEGLKASLMLSKLPSAMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 326 - DNA, 2295 bp, Artificial Sequence
  Cucurbitadienol synthase
atgtggaggctgaaggtgggagcagagagcgttggggaggaggatgagaaatgggtgaagagcgtaagcaatcacttgggccgccaagtttgggagttctgtgccgacgccgccgccgacactcctcaccagttactacaaattcagaatgctcgcaaccacttccatcacaatcgtttccaccggaagcagtcttccgatctctttctggctattcaatatgaaaaggaaatagcaaagggcgcaaaaggtggagcggtgaaagtgaaagaaggggaggaggtggggaaagaggcggtgaagagtacgttagaaagggcactcggtttctactcggccgtgcagacaagagatgggaattgggcctcggatcttggagggcccttgtttttacttccgggtctcgtgattgcccttcatgtcacaggcgtcttgaattcagttttgtccaagcaccaccgcgtagagatgtgcagatatctttacaatcaccagaatgaagatggagggtggggtctacatattgagggcacaagcaccatgtttggttcggcactgaattacgttgcactaaggctgcttggagaagacgccgatggcggagacggtggcgcaatgacaaaagcacgtgcttggatcttggagcgcggcggcgccactgcgatcacttcgtggggaaaattgtggctgtccgtacttggagtgtacgaatggagtggcaacaaccctcttccgcctgagttttggcttctcccttacagcctaccatttcatccaggaagaatgtggtgccattgtcgaatggtttatcttccaatgtcttacttatatgggaagagatttgttgggccaatcactcccaaagttctttctctaaggcaagagctctacacaattccttatcatgaaatagactggaataaatcccgcaatacatgtgcaaaggaggatctgtactatccacatcccaagatgcaagacattctatggggatccatctaccatgtatatgagccattgttcactcgttggcctgggaaacgcctgagggaaaaggctttacaagctgcaatgaaacatattcactatgaagatgaaaatagtcgatatatatgtcttggcccagtcaacaaggtactcaacatgctttgttgttgggttgaagatccctactcagacgccttcaaacttcaccttcaacgcgtccatgactatctctgggttgctgaagatggcatgagaatgcagggctacaatggcagccagttgtgggacactgctttctccatccaagccatcgtagccaccaaacttgtagacagctatgccccaactttaagaaaagcacatgactttgttaaggattctcagatccaggaggactgtcctggggatcctaatgtttggttccgtcatattcataaaggtgcttggccactttcgacacgagatcatggatggctcatctccgactgtacagctgagggattgaaggcttctttgatgttatccaaacttccatccacaatggttggggagccattagaaaagaatcgcctttgtgatgctgttaatgttctcctttctttgcaaaatgataatggtggatttgcatcatacgagttgacgagatcatacccttggttggagttgatcaacccagctgaaacattcggagacattgtcattgactatccgtatgtggagtgcaccgcagcaacaatggaagcactgacgttatttaagaagctacatccaggccataggaccaaagagattgacacagctattggcaaggcagccaacttccttgagaaaatgcagagggcggatggctcttggtacgggtgttggggggtttgttttacgtatgcgggttggtttggcataaagggattggtggctgcaggaagaacatataatagctgccttgccattcgcaaggcttgtgagtttctgctatctaaagagctgcccggcggtggatggggggagagttacctttcatgtcagaataaggtgtacaccaatcttgaggggaacaagccacacttggttaacactgcctgggttttaatggctctcattgaagctggccagggtgagagagacccagcaccattgcaccgtgcagcaaggttgctaatgaattcccaattggagaatggcgatttcgtgcaacaggagatcatgggagtgttcaataagaactgcatgatcacatatgctgcataccgaaacatcttccccatttgggcgcttggagagtattgccatcgggttcttactgaatga

SEQ ID NO: 327 - protein, 765 aa, Artificial Sequence
  Cucurbitadienol synthase Cmos1
MWRLKVGAESVGEKDEKWVKSVSNHLGRQVWEFCADAAAAATPRQLLQIQNARNHFHRNRFHRKQSSDLFLAIQYEKEIAEGGKGGAVKVKEEEEVGKEAVKSTLERALSFYSAVQTSDGNWASDLGGPMFLLPGLVIALYVTGVLNSVLSKHHRVEMCRYLYNHQNEDGGWGLHIEGTSTMFGSALNYVALRLLGEDADGGDDGAMTKARAWILERGGATAITSWGKLWLSVLGVYEWSGNNPLPPEFWLLPYSLPFHPGRMWCHCRMVYLPMSYLYGKRFVGPITPKVLSLRQELYTVPYHEIDWNKSRNTCAKEDLYYPHPKMQDILWGSIYHVYEPLFTRWPGKRLREKALQTAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPFSTRDHGWLISDCTAEGLKASLMLSKLPSAMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 328 - DNA, 2296 bp, Artificial Sequence
  Cucurbitadienol synthase Cmos1
atgtggaggttgaaggtgggagcagagagcgttggggagaaggatgagaaatgggtgaagagcgtaagcaatcacttgggccgccaagtttgggagttctgtgccgacgccgccgccgccgccactcctcgccagttactacaaattcagaatgctcgcaaccacttccatcgcaatcgtttccaccggaagcagtcttccgatctctttctcgctattcagtatgaaaaggaaatagcagagggcggaaaaggtggagcggtgaaagtgaaagaagaggaggaggtggggaaagaggcggtgaagagtacgttagaaagggcactaagtttctactcagccgtgcagacaagcgatgggaattgggcctcggatcttggagggcccatgtttttacttccgggtctcgtgattgccctttatgtcacaggcgtgttgaattcagttttgtccaagcaccaccgcgtagagatgtgcagatatctttacaatcaccagaatgaagatggagggtggggtctacatattgagggcacaagcaccatgtttggttcggcactcaattacgttgcactaaggctgcttggagaagacgcggatggcggagacgatggcgcaatgacaaaagcacgtgcttggatcttggagcgcggcggcgccactgcgatcacttcgtggggaaagttgtggctgtccgtgcttggagtgtacgaatggagtggcaacaaccctcttccgcctgagttttggcttctcccttacagcctaccatttcatccaggaagaatgtggtgccattgtcgaatggtttatcttcccatgtcttacttatatgggaagagatttgttgggccaatcactcccaaagttctatcgctaagacaagagctttacacggttccttatcatgaaatagactggaacaaatcccgcaatacatgtgcaaaggaggatctatactatccacatcccaagatgcaagacattctatggggatccatctaccatgtgtatgagccattgttcactcgttggcctgggaaacgcctgagggaaaaggctttacaaactgcaatgaaacatattcactatgaagatgaaaatagtcgatatatatgtcttggcccagtcaacaaggtactcaacatgctttgttgttgggttgaagatccctactcagacgccttcaaacttcaccttcaacgcgtccatgactatctctgggttgctgaagatggcatgagaatgcagggctacaatggcagccagttgtgggacactgctttctccatccaagccatcgtagccaccaaacttgtagacagctatgccccaactttaagaaaagcacatgactttgttaaggattctcagatccaggaggactgtcctggggatcctaatgtttggttccgtcatattcataaaggtgcttggccattttcgactcgagatcatggatggctcatctccgactgtacagctgagggattgaaggcttctttgatgttatccaaacttccatccgcaatggttggggagccattagaaaagaatcgcctttgtgatgctgttaatgttctcctttctttgcaaaatgataatggtggatttgcatcatacgagttgacgagatcatacccttggttggagttgatcaacccagcagaaacattcggagacattgtcatcgactatccgtatgtggagtgcaccgcagcaacaatggaagcactgacgttatttaagaagctacatccaggccataggaccaaagagattgacacagctattggcaaggcagccaacttccttgagaaaatgcagagggcggatggctcttggtatgggtgttggggggtttgtttcacgtatgcggggtggtttggcataaagggattggtggctgcaggaagaacatataatagctgccttgccatccgcaaggcttgtgagtttctgctatctaaagagctgcccggcggtggatggggggagagttacctttcatgtcagaataaggtgtacaccaatcttgagggaaacaagccacacttggttaacactgcctgggttttaatggctctcattgaagctggccagggtgagagagacccagcaccattgcaccgtgcagcaaggttgctaatgaattcccaattggagaatggcgatttcgtgcaacaggagatcatgggagtgttcaataagaactgcatgatcacatatgctgcataccgaaacatcttccccatttgggcgcttggagagtattgccatcgggttctgactgaat

SEQ ID NO: 329 - protein, 774 aa, Artificial Sequence
  Cucurbitadienol synthase cucumis melo
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 330 - protein, 764 aa, Artificial Sequence
  Cucurbitadienol synthase Citrullus colocynthis
MWRLKVGAESVGEKEEKWLKSISNHLGRQVWEFCADQPTASPNHLQQIDNARKHFRNNRFHRKQSSDLFLAIQNEKEIANGTKGGGIKVKEEEDVRKETVKNTVERALSFYSAIQTNDGNWASDLGGPMFLLPGLVIALYVTGVLNSVLSKHHRQEMCRYLYNHQNEDGGWGLHIEGTSTMFGSALNYVALRLLGEDADGGEGGAMTKARGWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNKSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWIAEDGMRMQGYNGSQLWDTAFSVQAIISTKLIDSFGTTLKKAHDFVKDSQIQQDFPGDPNVWFRHIHKGAWPFSTRDHGWLISDCTAEGLKASLMLSKLPSKIVGEPLEKSRLCDAVNVLLSLQNENGGFASYELTRSYPWLELINPAETFGDIVIDYPYVECTSATMEALTLFKKLHPGHRTKEIDTAVAKAANFLENMQRTDGSWYGCWGVCFTYAGWFGIKGLVAAGRTYSTCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 331 - protein, 764 aa, Artificial Sequence; identical to SEQ ID NO: 71
  Cucurbitadienol synthase Cucurbita pepo

SEQ ID NO: 332 - protein, 785 aa, Artificial Sequence
  Cucurbitadienol synthase Cucumis sativa
MWRLKVGKESVGEKEEKWIKSISNHLGRQVWEFCAENDDDDDDEAVIHVVANSSKHLLQQQRRQSSFENARKQFRNNRFHRKQSSDLFLTIQYEKEIARNGAKNGGNTKVKEGEDVKKEAVNNTLERALSFYSAIQTSDGNWASDLGGPMFLLPGLVIALYVTGVLNSVLSKHHRQEMCRYIYNHQNEDGGWGLHIEGSSTMFGSALNYVALRLLGEDANGGECGAMTKARSWILERGGATAITSWGKLWLSVLGVYEWSGNNPLPPEFWLLPYSLPFHPGRMWCHCRMVYLPMSYLYGKRFVGPITHMVLSLRKELYTIPYHEIDWNRSRNTCAQEDLYYPHPKMQDILWGSIYHVYEPLFNGWPGRRLREKAMKIAMEHIHYEDENSRYIYLGPVNKVLNMLCCWVEDPYSDAFKFHLQRIPDYLWLAEDGMRMQGYNGSQLWDTAFSIQAILSTKLIDTFGSTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAALAKAANFLENMQRTDGSWYGCWGVCFTYAGWFGIKGLVAAGRTYNNCVAIRKACHFLLSKELPGGGWGESYLSCQNKVYTNLEGNRPHLVNTAWVLMALIEAGQGERDPAPLHRAARLLINSQLENGDFPQQEIMGVFNKNCMITYAAYRNIFPIWALGEYSHRVLTE

SEQ ID NO: 333 - protein, 647 aa, Artificial Sequence
  Cucurbitadienol synthase Citrullus lanatus
DGNWASDLGGPMFLLPGLVIALYVTGVLNSVLSKHHRQEMCRYLYNHQNEDGGWGLHIEGTSTMFGSALNYVALRLLGEDADGGEGGAMTKARSWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNRSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWVAEDGMRMQGYNGSQLWDTAFSVQAIISTKLIDSFGTTLKKAHDFVKDSQIQQDCPGDPNVWFRHIHKGAWPFSTRDHGWLISDCTAEGLKASLMLSKLPSEIVGEPLEKSRLCDAVNVLLSLQNENGGFASYELTRSYPWLELINPAETFGDIVIDYPYVECTSATMEALTLFKKLHPGRRTKEIDIAVARAANFLENMQRTDGSWYGCWGVCFTYAGWFGIKGLVAAGRTYNSCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 334 - protein, 496 aa, Artificial Sequence; identical to SEQ ID NO: 50
  Squalene epoxidase/squalene monooxidase

SEQ ID NO: 335 - DNA, 1491 bp, Artificial Sequence
  Squalene epoxidase/squalene monooxidase
atgtctgctgttaacgttgcacctgaattgattaatgccgacaacacaattacctacgatgcgattgtcatcggtgctggtgttatcggtccatgtgttgctactggtctagcaagaaagggtaagaaagttcttatcgtagaacgtgactgggctatgcctgatagaattgttggtgaattgatgcaaccaggtggtgttagagcattgagaagtctgggtatgattcaatctatcaacaacatcgaagcatatcctgttaccggttataccgtctttttcaacggcgaacaagttgatattccatacccttacaaggccgatatccctaaagttgaaaaattgaaggacttggtcaaagatggtaatgacaaggtcttggaagacagcactattcacatcaaggattacgaagatgatgaaagagaaaggggtgttgcttttgttcatggtagattcttgaacaacttgagaaacattactgctcaagagccaaatgttactagagtgcaaggtaactgtattgagatattgaaggatgaaaagaatgaggttgttggtgccaaggttgacattgatggccgtggcaaggtggaattcaaagcccacttgacatttatctgtgacggtatcttttcacgtttcagaaaggaattgcacccagaccatgttccaactgtcggttcttcgtttgtcggtatgtctttgttcaatgctaagaatcctgctcctatgcacggtcacgttattcttggtagtgatcatatgccaatcttggtttaccaaatcagtccagaagaaacaagaatcctttgtgcttacaactctccaaaggtcccagctgatatcaagagttggatgattaaggatgtccaacctttcattccaaagagtctacgtccttcatttgatgaagccgtcagccaaggtaaatttagagctatgccaaactcctacttgccagctagacaaaacgacgtcactggtatgtgtgttatcggtgacgctctaaatatgagacatccattgactggtggtggtatgactgtcggtttgcatgatgttgtcttgttgattaagaaaataggtgacctagacttcagcgaccgtgaaaaggttttggatgaattactagactaccatttcgaaagaaagagttacgattccgttattaacgttttgtcagtggctttgtattctttgttcgctgctgacagcgataacttgaaggcattacaaaaaggttgtttcaaatatttccaaagaggtggcgattgtgtcaacaaacccgttgaatttctgtctggtgtcttgccaaagcctttgcaattgaccagggttttcttcgctgtcgctttttacaccatttacttgaacatggaagaacgtggtttcttgggattaccaatggctttattggaaggtattatgattttgatcacagctattagagtattcaccccatttttgtttggtgagttgattggttaa

SEQ ID NO: 336 - protein, 444 aa, Artificial Sequence; identical to SEQ ID NO: 69
  Squalene synthase Erg9

SEQ ID NO: 337 - DNA, 1335 bp, Artificial Sequence
  Squalene synthase Erg9
atgggaaagctattacaattggcattgcatccggtcgagatgaaggcagctttgaagctgaagttttgcagaacaccgctattctccatctatgatcagtccacgtctccatatctcttgcactgtttcgaactgttgaacttgacctccagatcgtttgctgctgtgatcagagagctgcatccagaattgagaaactgtgttactctcttttatttgattttaagggctttggataccatcgaagacgatatgtccatcgaacacgatttgaaaattgacttgttgcgtcacttccacgagaaattgttgttaactaaatggagtttcgacggaaatgcccccgatgtgaaggacagagccgttttgacagatttcgaatcgattcttattgaattccacaaattgaaaccagaatatcaagaagtcatcaaggagatcaccgagaaaatgggtaatggtatggccgactacatcttagatgaaaattacaacttgaatgggttgcaaaccgtccacgactacgacgtgtactgtcactacgtagctggtttggtcggtgatggtttgacccgtttgattgtcattgccaagtttgccaacgaatctttgtattctaatgagcaattgtatgaaagcatgggtcttttcctacaaaaaaccaacatcatcagagattacaatgaagatttggtcgatggtagatccttctggcccaaggaaatctggtcacaatacgctcctcagttgaaggacttcatgaaacctgaaaacgaacaactggggttggactgtataaaccacctcgtcttaaacgcattgagtcatgttatcgatgtgttgacttatttggccggtatccacgagcaatccactttccaattttgtgccattccccaagttatggccattgcaaccttggctttggtattcaacaaccgtgaagtgctacatggcaatgtaaagattcgtaagggtactacctgctatttaattttgaaatcaaggactttgcgtggctgtgtcgagatttttgactattacttacgtgatatcaaatctaaattggctgtgcaagatccaaatttcttaaaattgaacattcaaatctccaagatcgaacagtttatggaagaaatgtaccaggataaattacctcctaacgtgaagccaaatgaaactccaattttcttgaaagttaaagaaagatccagatacgatgatgaattggttccaacccaacaagaagaagagtacaagttcaatatggttttatctatcatcttgtccgttcttcttgggttttattatatatacactttacacagagcgtga

SEQ ID NO: 338 - protein, 352 aa, Artificial Sequence
  Farnesyl PP synthase
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 339 - DNA, 1059 bp, Artificial Sequence
  Farnesyl PP synthase
atggcttcagaaaaagaaattaggagagagagattcttgaacgttttccctaaattagtagaggaattgaacgcatcgcttttggcttacggtatgcctaaggaagcatgtgactggtatgcccactcattgaactacaacactccaggcggtaagctaaatagaggtttgtccgttgtggacacgtatgctattctctccaacaagaccgttgaacaattggggcaagaagaatacgaaaaggttgccattctaggttggtgcattgagttgttgcaggcttacttcttggtcgccgatgatatgatggacaagtccattaccagaagaggccaaccatgttggtacaaggttcctgaagttggggaaattgccatcaatgacgcattcatgttagaggctgctatctacaagcttttgaaatctcacttcagaaacgaaaaatactacatagatatcaccgaattgttccatgaggtcaccttccaaaccgaattgggccaattgatggacttaatcactgcacctgaagacaaagtcgacttgagtaagttctccctaaagaagcactccttcatagttactttcaagactgcttactattctttctacttgcctgtcgcattggccatgtacgttgccggtatcacggatgaaaaggatttgaaacaagccagagatgtcttgattccattgggtgaatacttccaaattcaagatgactacttagactgcttcggtaccccagaacagatcggtaagatcggtacagatatccaagataacaaatgttcttgggtaatcaacaaggcattggaacttgcttccgcagaacaaagaaagactttagacgaaaattacggtaagaaggactcagtcgcagaagccaaatgcaaaaagattttcaatgacttgaaaattgaacagctataccacgaatatgaagagtctattgccaaggatttgaaggccaaaatttctcaggtcgatgagtctcgtggcttcaaagctgatgtcttaactgcgttcttgaacaaagtttacaagagaagcaaatag

SEQ ID NO: 340 - protein, 755 aa, Artificial Sequence
  Cycloartenol synthase
MWKLKVAEGGTPWLRTLNNHVGRQVWEFDPHSGSPQDLDDIETARRNFHDNRFTHKHSDDLLMRLQFAKENPMNEVLPKVKVKDVEDVTEEAVATTLRRGLNFYSTIQSHDGHWPGDYGGPMFLMPGLVITLSVTGALNAVLTDEHRKEMRRYLYNHQNKDGGWGLHIEGPSTMFGSVLCYVTLRLLGEGPNDGEGDMERGRDWILEHGGATYITSWGKMWLSVLGVFEWSGNNPMPPEWLLPYALPVHPGRMWCHCRMVYLPMSYLYGKRFVGPITPTVLSLRKELFTVPYHDIDWNQARNLCAKEDLYYPHPLVQDILWATLHKFVEPVFMNWPGKKLREKAIKTAIEHIHYEDENTRYICIGPVNKVLNMLCCWVEDPNSEAFKLHLPRIYDYLWVAEDGMKMQGYNGSQLWDTAFAAQAIISTNLIDEFGPTLKKAHAFIKNSQVSEDCPGDLSKWYRHISKGAWPFSTADHGWPISDCTAEGLKAVLLLSKIAPEIVGEPLDSKRLYDAVNVILSLQNENGGLATYELTRSYTWLEIINPAETFGDIVIDCPYVECTSAAIQALATFGKLYPGHRREEIQCCIEKAVAFIEKIQASDGSWYGSWGVCFTYGTWFGIKGLIAAGKNFSNCLSIRKACEFLLSKQLPSGGWAESYLSCQNKVYSNLEGNRSHVVNTGWAMLALIEAEQAKRDPTPLHRAAVCLINSQLENGDFPQEEIMGVFNKNCMITYAAYRCIFPIWALGEYRRVLQAC

SEQ ID NO: 341 - protein, 756 aa, Artificial Sequence
  Oxidosqualene cylcases
MWKLKVAEGGTPWLRTLNNHVGRQVWEFDPHSGSPQDLDDIETARRNFHDNRFTHKHSDDLLMRLQFAKENPMNEVLPKVKVKDVEDVTEEAVATTLRRGLNFYSTIQSHDGHWPGDLGGPMFLMPGLVITLSVTGALNAVLTDEHRKEMRRYLYNHQNKDGGWGLHIEGPSTMFGSVLCYVTLRLLGEGPNDGEGDMERGRDWILEHGGATYITSWGKMWLSVLGVFEWSGNNPMPPEIWLLPYALPVHPGRMWCHCRMVYLPMSYLYGKRFVGPITPTVLSLRKELFTVPYHDIDWNQARNLCAKEDLYYPHPLVQDILWATLHKFVEPVFMNWPGKKLREKAIKTAIEHIHYEDENTRYICIGPVNKVLNMLCCWVEDPNSEAFKLHLPRIYDYLWVAEDGMKMQGYNGSQLWDTAFAAQAIISTNLIDEFGPTLKKAHAFIKNSQVSEDCPGDLSKWYRHISKGAWPFSTADHGWPISDCTAEGLKAVLLLSKIAPEIVGEPLDSKRLYDAVNVILSLQNENGGLATYELTRSYTWLEIINPAETFGDIVIDCPYVECTSAAIQALATFGKLYPGHRREEIQCCIEKAVAFIEKIQASDGSWYGSWGVCFTYGTWFGIKGLIAAGKNFSNCLSIRKACEFLLSKQLPSGGWAESYLSCQNKVYSNLEGNRSHVVNTGWAMLALIEAEQAKRDPTPLHRAAVCLINSQLENGDFPQEEIMGVFNKNCMITYAAYRCIFPIWALGEYRRVLQAC

SEQ ID NO: 342 - DNA, 2274 bp, Artificial Sequence
  Oxidosqualene cylcases
atgtggaggctaacaataggtgagggcggcggtccgtggctgaagtcgaacaatggcttccttggccgccaagtgtgggagtacgacgccgatgccggcacgccggaagagcgtgccgaggttgagagggtgcgtgcggaattcacaaagaacaggttccagaggaaggagtcacaggaccttcttctacgcttgcagtacgcaaaagacaaccctcttccggcgaatattccgacagaagccaagcttgaaaagagtacagaggtcactcacgagactatctacgaatcattgatgcgagctttacatcaatattcctctctacaagcagacgatgggcattggcctggtgattacagtgggattctcttcattatgcctatcattatattctctttatatgttactagatcacttgacacctttttatctccggaacatcgtcatgagatatgtcgctacatttacaatcaacagaatgaagatggtggttggggaaaaatggttcttggcccaagtaccatgtttggatcgtgtatgaattatgcaaccttaatgattcttggcgagaagcgaaatggtgatcataaggatgcattggaaaaagggcgttcttggattttatctcatggaactgcaactgcaataccacagtggggaaaaatatggttgtcgataattggcgtttacgaatggtcaggaaacaatcctattatacctgaattgtggttggttccacattttcttccgattcacccaggtcgtttttggtgttttacccggttgatatacatgtcaatggcatatctctatggtaagaaatttgttgggcctattagtcctacaatattagctctgcgacaagacctctatagtataccttactgcaacattaattgggacaaggcgcgtgattattgtgcaaaggaggaccttcattacccacgctcacgggcacaagatcttatatctggttgcctaacgaaaattgtggagccaattttgaattggtggccagcaaacaagctaagagatagagctttaactaacctcatggagcatatccattatgacgacgaatcaaccaaatatgtgggcatttgccctattaacaaggcattgaacatgatttgttgttgggtagaaaacccaaattcgcctgaattccaacaacatcttccacgattccatgactatttgtggatggcggaggatggaatgaaggcacaggtatatgatggatgtcatagctgggaactagcgttcataattcatgcctattgttccacggatcttactagcgagtttatcccgactctaaaaaaggcgcacgagttcatgaagaactcacaggttcttttcaaccacccaaatcatgaaagctattatcgccacagatcaaaaggctcatggaccctttcaagtgtagataatggttggtctgtatctgattgtactgcggaagctgttaaggcattgctactattatcaaagatatccgctgaccttgttggcgatccaataaaacaagacaggttgtatgatgccattgattgcatcctatctttcatgaatacagatggaacattttctacctacgaatgcaaacggacattcgcttggttagaggttctcaacccttctgagagttttcggaacattgtcgtggactatccatctgttgaatgcacatcatctgtggttgatgctctcatattatttaaagagacgaatccacgatatcgaagagcagagatagataaatgcattgaagaagctgttgtatttattgagaacagtcaaaataaggatggttcatggtatggctcatggggtatatgtttcgcatatggatgcatgtttgcagtaagggcgttggttgctacaggaaaaacctacgacaattgtgcttctatcaggaaatcatgcaaatttgtcttatcaaagcaacaaacaacaggtggatggggtgaagactatctttctagtgacaatggggaatatattgatagcggtaggcctaatgctgtgaccacctcatgggcaatgttggctttaatttatgctggacaggttgaacgtgacccagtaccactgtataatgctgcaagacagctaatgaatatgcagctagaaacaggtgacttcccccaacaggaacacatgggttgcttcaactcctccttgaacttcaactacgccaactaccgcaatctatacccgattatggctcttggggaacttcgccgtcgacttcttgcgattaagagctga

SEQ ID NO: 343 - protein, 756 aa, Artificial Sequence; identical to SEQ ID NO: 341
  Cycloartenol synthase

SEQ ID NO: 344 - protein, 755 aa, Artificial Sequence
  Beta-amyrin synthase
MWRLTIGEGGGPWLKSNNGFLGRQVWEYDADAGTPEERAEVERRAEFTKNRFQRKESQDLLLRLQYAKDNPLPANIPTEAKLEKSTEVTHETIYESLMRALHQYSSLQADDGHWPGDYSGILFIMPIIIFSLYVTRSLDTFLSPEHRHEICRYIYNQQNEDGGWGKMVLGPSTMFGSCMNYATLMILGKRNGDHKDALEKGRSWILSHGTATAIPQWGKIWLSIIGVYEWSGNNPIIPELWLVPHFLPIHPGRFWCFTRLIYMSMAYLYGKKFVGPISPTILALRQDLYSIPYCNINWDKARDYCAKEDLHYPRSRAQDLISGCLTKIVEPILNWWPANKLRDRALTNLMEHIHYDDESTKYVGICPINKALNMICCWVENPNSPEFQQHLPRFHDYLWMAEDGMKAQVYDGCHSWELAFIIHAYCSTDLTSEFIPTLKKAHEFMKNSQVLFNHPNHESYYRHRSKGSWTLSSVDNGWSVSDCTAEAVKALLLLSKISADLVGDPIKQDRLYDAIDCILSFMNTDGTFSTYECKRTFAWLEVLNPSESFRNIVVDYPSVECTSSVVDALILFKETNPRYRRAEIDKCIEEAVVFIENSQNKDGSWYGSWGICFAYGCMFAVRALVATGKTYDNCASIRKSCKFVLSKQQTTGGWGEDYLSSDNGEYIDSGRPNAVTTSWAMLALIYAGQVERDPVPLYNAARQLMNMQLETGDFPQQEHMGCFNSSLNFNYANYRNLYPIMALGELRRRLLAIKS

SEQ ID NO: 345 - DNA, 2273 bp, Artificial Sequence
  Beta-amyrin synthase
atgtggaggctaacaataggtgagggcggcggtccgtggctgaagtcgaacaatggcttccttggccgccaagtgtgggagtacgacgccgatgccggcacgccggaagagcgtgccgaggttgagagggtgcgtgcggaattcacaaagaacaggttccagaggaaggagtcacaggaccttcttctacgcttgcagtacgcaaaagacaaccctcttccggcgaatattccgacagaagccaagcttgaaaagagtacagaggtcactcacgagactatctacgaatcattgatgcgagctttacatcaatattcctctctacaagcagacgatgggcattggcctggtgattacagtgggattctcttcattatgcctatcattatattctctttatatgttactagatcacttgacacctttttatctccggaacatcgtcatgagatatgtcgctacatttacaatcaacagaatgaagatggtggttggggaaaaatggttcttggcccaagtaccatgtttggatcgtgtatgaattatgcaaccttaatgattcttggcgagaagcgaaatggtgatcataaggatgcattggaaaaagggcgttcttggattttatctcatggaactgcaactgcaataccacagtggggaaaaatatggttgtcgataattggcgtttacgaatggtcaggaaacaatcctattatacctgaattgtggttggttccacattttcttccgattcacccaggtcgtttttggtgttttacccggttgatatacatgtcaatggcatatctctatggtaagaaatttgttgggcctattagtcctacaatattagctctgcgacaagacctctatagtataccttactgcaacattaattgggacaaggcgcgtgattattgtgcaaaggaggaccttcattacccacgctcacgggcacaagatcttatatctggttgcctaacgaaaattgtggagccaattttgaattggtggccagcaaacaagctaagagatagagctttaactaacctcatggagcatatccattatgacgacgaatcaaccaaatatgtgggcatttgccctattaacaaggcattgaacatgatttgttgttgggtagaaaacccaaattcgcctgaattccaacaacatcttccacgattccatgactatttgtggatggcggaggatggaatgaaggcacaggtatatgatggatgtcatagctgggaactagcgttcataattcatgcctattgttccacggatcttactagcgagtttatcccgactctaaaaaaggcgcacgagttcatgaagaactcacaggttcttttcaaccacccaaatcatgaaagctattatcgccacagatcaaaaggctcatggaccctttcaagtgtagataatggttggtctgtatctgattgtactgcggaagctgttaaggcattgctactattatcaaagatatccgctgaccttgttggcgatccaataaaacaagacaggttgtatgatgccattgattgcatctatctttcatgaatacagatggaacattttctacctacgaatgcaaacggacattcgcttggttagaggttctcaacccttctgagagttttcggaacattgtcgtggactatccatctgttgaatgcacatcatctgtggttgatgctctcatattatttaaagagacgaatccacgatatcgaagagcagagatagataaatgcattgaagaagctgttgtatttattgagaacagtcaaaataaggatggttcatggtatggctcatggggtatatgtttcgcatatggatgcatgtttgcagtaagggcgttggttgctacaggaaaaacctacgacaattgtgcttctatcaggaaatcatgcaaatttgtcttatcaaagcaacaaacaacaggtggatggggtgaagactatctttctagtgacaatggggaatatattgatagcggtaggcctaatgctgtgaccacctcatgggcaatgttggctttaatttatgctggacaggttgaacgtgacccagtaccactgtataatgctgcaagacagctaatgaatatgcagctagaaacaggtgacttcccccaacaggaacacatgggttgcttcaactcctccttgaacttcaactacgccaactaccgcaatctatacccgattatggctcttggggaacttcgccgtcgacttcttgcgattaagagctga

SEQ ID NO: 346 - protein, 757 aa, Artificial Sequence
  Modified sequence of B-amyrin synthase from Avena strigosa (AJ311789) to react preferentially with diepoxysqualene
MWRLTIGEGGGPWLKSNNGFLGRQVWEYDADAGTPEERAEVERVRAEFTKNRFQRKESQDLLLRLQYAKDNPLPANIPTEAKLEKSTEVTHETIYESLMRALHQYSSLQADDGHWPGDYSGILFIMPIIIFSLYVTRSLDTFLSPEHRHEICRYIYNQQNEDGGWGKMVLGPSTMFGSCMNYATLMILGEKRNGDHKDALEKGRSWILSHGTATAIPQWGKIWLSIIGVYEWSGNNPIIPELWLVPHFLPIHPGRFWCFTRLIYMSMAYLYGKKFVGPISPTILALRQDLYSIPYCNINWDKARDYCAKEDLHYPRSRAQDLISGCLTKIVEPILNWWPANKLRDRALTNLMEHIHYDDESTKYVGICPINKALNMICCWVENPNSPEFQQHLPRFHDYLWMAEDGMKAQVYDGCHSWELAFIIHAYCSTDLTSEFIPTLKKAHEFMKNSQVLFNHPNHESYYRHRSKGSWTLSSVDNGWSVSDCTAEAVKALLLLSKISADLVGDPIKQDRLYDAIDCILSFMNTDGTFSTYECKRTFAWLEVLNPSESFRNIVVDYPSVECTSSVVDALILFKETNPRYRRAEIDKCIEEAVVFIENSQNKDGSWYGSWGICFAYGCMFAVRALVATGKTYDNCASIRKSCKFVLSKQQTTGGWGEDYLSSDNGEYIDSGRPNAVTTSWAMLALIYAGQVERDPVPLYNAARQLMNMQLETGDFPQQEHMGCFNSFLNFNYANYRNLYPIMALGELRRRLLAIKS

SEQ ID NO: 347 - protein, 757 aa, Artificial Sequence
  Modified sequence of from Arabidopsis thaliana (AtLup1, Q9C5M3.1) to react preferentially with diepoxysqualene
MWKLKIGKGNGEDPHLFSSNNFVGRQTWKFDHKAGSPEERAAVEEARRGFLDNRFRVKGCSDLLWRMQFLREKKFEQGIPQLKATNIEEITYETTTNALRRGVRYFTALQASDGHWPGEITGPLFFLPPLIFCLYITGHLEEVFDAEHRKEMLRHIYCHQNEDGGWGLHIESKSVMFCTVLNYICLRMLGENPEQDACKRARQWILDRGGVIFIPSWGKFWLSILGVYDWSGTNPTPPELLMLPSFLPIHPGKILCYSRMVSIPMSYLYGKRFVGPITPLILLLREELYLEPYEEINWKKSRRLYAKEDMYYAHPLVQDLLSDTLQNFVEPLLTRWPLNKLVREKALQLTMKHIHYEDENSHYITIGCVEKVLCMLACWVENPNGDYFKKHLARIPDYMWVAEDGMKMQSFGCQLWDTGFAIQALLASNLPDETDDALKRGHNYIKASQVRENPSGDFRSMYRHISKGAWTFSDRDHGWQVSDCTAEALKCCLLLSMMSADIVGQKIDDEQLYDSVNLLLSLQSGNGGVNAWEPSRAYKWLELLNPTEFMANTMVEREFVECTSSVIQALDLFRKLYPDHRKKEINRSIEKAVQFIQDNQTPDGSWYGNWGVCFIYATWFALGGLAAAGETYNDCLAMRNGVHFLLTTQRDDGGWGESYLSCSEQRYIPSEGERSNLVQTSWAMMALIHTGQAERDLIPLHRAAKLIINSQLENGDFPQQEIVGAFMNFCMLHYATYRNTFPLWALAEYRKVVFIVN

SEQ ID NO: 348-351 - skipped (4 entries)

SEQ ID NO: 352 - protein, 601 aa, Artificial Sequence; identical to SEQ ID NO: 289
  XP_001396506.2

SEQ ID NO: 353 - skipped

SEQ ID NO: 354 - protein, 895 aa, Artificial Sequence
  beta-glucosidase [Trichoderma reesei], GenBank: BAP5915.1
MTSFHDGVKLSTVTCVLSGLVALGSAGPTAASANAQVAAAAAAQAWVPDGYYVPPYYPAPYGGWVEDWQESYTKAKALVDSMTLAEKTNITAGTGIYMGERCAGNTGSAFRVSFPQLCLNDSPAGVRHADNVTAFPDGITVGATFDKALMYKRGVAIGKENRGKGVNVWLGPTVGPIGRKPKGGRNWEGFGADPVLQAVGARETIKGVQEQGVIATIKHFIGNEQEMYRMYNPFQYAYSSNIDDRTLHEVYAWPFAEGIRAGVGAVMMAYNAVNGTACSQHPYLMSALLKDEMGFQGFIMTDWLAHMSGVASAIAGLDMDMPGDVQIPFFGGSYWMYELTRSALNGSVPMDRINDAATRIAAAWYKMGQDKGFPATNFDTNSRAAFNPLYPAALPLSPFGITNEFVPVQDDHDVIARQISQEAITLLKNDGDILPLSPSQHLKVFGTDAQKNPDGINSCTDRNCNKGTLGQGWGSGTVDYPYLDDPISAITAEADNVTFYNTDKFPSVGEVSDSDVAIVFVNSDAGENTYTVEGNHGDRDKSGLYAWHDGDKLVQDAASKFSNVIVVIHTVGPLILEKWIDLPSVKAVLVAHLPGQEAGKSLTNVLFGHASPCGHLPYSITKEEDDLPKSVTTLIDSEFLNQPQDTYTEGLYIDYRWLNKNKTKPRYAFGHGLSYTNFTFKAASIKQVARLSAYPPARPAKGSTPDFAQSIPSASEAVAPSGFGKIPRYIYSWLSQGDANRAISDGKTGKYPYPDGYSTTQKPGARAGGGEGGNPALWDVAYSLTVTVQNTGDEYAGKASVQAYLQFPDDIDYDTPIIQLRDFEKTKELKPGETTTVTLTLTRKDVSVWDVVAQDWKVPAVDGGYKVWIGDASDSLSIVCHTDTLECETGVVGPV

SEQ ID NO: 355 - protein, 831 aa, Artificial Sequence
  beta-glucosidase [Trichodermareesei] 831 aa protein BAP59014.1 GI:690966588
MMGFDVEDVLSQLSQNEKIALLSGIDFWHTYPIPKYNVPSVRLTDGPNGIRGTKFFAGIPAACLPCGTALASTWDKQLLKKAGKLLGDECIAKGAHCWLGPTINTPRSPLGGRGFESFSEDPYLSGILAASMILGCESTGVISAVKHFVANDQEHERRAVDCLITQRALREVYLRPFQIVARDARPGALMTSYNKVNGKHVADSAEFLQGILRTEWNWDPLIVSDWYGTYTTIDAIKAGLDLEMPGVSRYRGKYIESALQARLLKQSTIDERARRVLRFAQKASHLKVSEVEQGRDFPEDRVLNRQICGSSIVLLKNENSILPLPKSVKKVALVGSHVRLPAISGGGSASLVPYYAISLYDAVSEVLAGATITHEVGAYAHQMLPVIDAMISNAVIHFYNDPIDVKDRKLLGSENVSSTSFQLMDYNNIPTLNKAMFWGTLVGEFIPTATGIWEFGLSVFGTADLYIDNELVIENTTHQTRGTAFFGKGTTEKVATRRMVAGSTYKLRLEFGSANTTKMETTGVVNFGGGAVHLGACLKVDPQEMIARAVKAAADADYTIICTGLSGEWESEGFDRPHMDLPPGVDTMISQVLDAAPNAVVVNQSGTPVTMSWAHKAKAIVQAWYGGNETGHGISDVLFGNVNPSGKLSLSWPVDVKHNPAYLNYASVGGRVLYGEDVYVGYKFYDKTEREVLFPFGHGLSYATFKLPDSTVRTVPETFHPDQPTVAIVKIKNTSSVPGAQVLQLYISAPNSPTHRPVKELHGFEKVYLEAGEEKEVQIPIDQYATSFWDEIESMWKSERGIYDVLVGFSSQEISGKGKLIVPETRFWMGL

SEQ ID NO: 356 - protein, 466 aa, Artificial Sequence
  beta-glucosidase [Trichoderma reesei] 466 aa protein AHK23047.1 GI:588294532
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVDDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWISKRYGYPPIYVTENGTSIKGESDLPKEKILEDDFRVKYYNEYIRAMVTAVELDGVNVKGYFAWSLMDNFEWADGYVTRFGVTYVDYENGQKRFPKKSAKSLKPLFDELIAAA

SEQ ID NO: 357 - protein, 466 aa, Artificial Sequence; identical to SEQ ID NO: 356
  beta-glucosidase [Trichoderma reesei] 466 aa protein BAA74959.1 GI:4249562

SEQ ID NO: 358 - protein, 466 aa, Artificial Sequence; identical to SEQ ID NO: 356
  beta-glucosidase [Trichoderma reesei RUT C-3] 466 aa protein ETS5552.1 GI:572282538

SEQ ID NO: 359 - protein, 473 aa, Artificial Sequence
  Chain D, Crystal Structure Of Beta-Glucosidase 2 From  Fungus Trichoderma Reesei In Complex With Tris 473 aa protein 3AHY_D GI:303324838
MHHHHHHMLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVDDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWISKRYGYPPIYVTENGTSIKGESDLPKEKILEDDFRVKYYNEYIRAMVTAVELDGVNVKGYFAWSLMDNFEWADGYVTRFGVTYVDYENGQKRFPKKSAKSLKPLFDELIAAA

SEQ ID NO: 360 - protein, 473 aa, Artificial Sequence; identical to SEQ ID NO: 359
  ChainC, Crystal Structure Of Beta-Glucosidase 2 From  Fungus Trichoderma Reesei In Complex With Tris 473 aa protein 3AHY_C GI:33324837

SEQ ID NO: 361 - protein, 473 aa, Artificial Sequence; identical to SEQ ID NO: 359
  Chain B, Crystal Structure Of Beta-Glucosidase 2 From Fungus Trichoderma Reesei In Complex With Tris 473 aa protein 3AHY_B GI:303324836

SEQ ID NO: 362 - protein, 473 aa, Artificial Sequence; identical to SEQ ID NO: 359
  Chain A, Crystal Structure Of Beta-Glucosidase 2 From Fungus Trichoderma Reesei In Complex With Tris 473 aa protein 3AHY_A GI:303324835

SEQ ID NO: 363 - protein, 949 aa, Artificial Sequence
  beta-glucosidaselike protein [Trichoderma reesei] 949 aa protein BAP59016.1 GI:690966592
MRLKHWKTAAFAAASIVSQVEAGFWNFGRDTSSSTRPPTKDQFIESLISKLTLEDLVLQLHLMFADDIVGAASHNELYDQTMHLSPKSPIGTIHDWYPMNKSYFNVLQKLQLDNSHVKIPMMLVEECLHGVGSFKQSIFPQNIAMAASFDTDIVYRVGRAIGTEARSIGIHGCFSPVLDLAQDPRWGRVQEDFGEDKILTSHIGSAYSSGLSKNKTWSDPDAVFPIMKHFAAHGAAQAGHNTAPFTGLGPRQIKQDLLVPFKANYDLGGARGVMMAYNEIDGVPSCVNPMLYEVLDDWGYDGIVIGDDTAMRNLLTQHRVTTSEADTLQQWYNAGGQIDFYDFDLDSKINITKALVANGTVPLKTLQSHVRKILGVKWDLGLFENPYIPEHIDPLAVVASHQDVALEAAHKSIILLKNDNRTLPLSSPKKIALIGPFADTINLGDYSGALGQYPAKYTQTLREGVLRHANKSGHTVRTSWGTNSWEYNNQYVIPGYLLSTNGKPGGLKATYYAHTNFTSPKATRVEVPAQDWGLYPPPGLSSNNFSAVWEGELESPTDLDVNGWIGLAIGPNSTSKLYVDGKLISSKGYSGSGNLLGTIEGYAWTQANSTLPPQGGVEFTFKKNAKHHVRIEFQSWNNYKKTANVNSVNSQLIFWWNLVSPNGKALDQAVSIAKDSDVVILAVGAAWNSDGESGDRGTLGLAPSQDELAREVFALGKPVVLVLEGGRPSAIPDHYGNSSAVLSTFFGGQAGGQAIADVLFGDFNPGARVPITVPWSVGQIPAYYNYKPSARAAQYLDIPSEPIYPFGYGLSYTTFSTSSPTASVSGSSKRSSVDAQTSQSFGSGDWITFSVTVKNTGSVAGSYVAQVYLLGRVSTITQPVKQLVGFQRVYLEAGQKKTANIQLEVDRYLKIINRKDEWELEKGSYTFALLEHGGSNADTSKNVTLQCVG

SEQ ID NO: 364 - protein, 744 aa, Artificial Sequence
  extracellularbeta glucosidase 744 aa protein 1713235A GI:227874
MRYRTAAALALATGPFARADSHSTSGASAEAVVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWDAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 365 - protein, 713 aa, Artificial Sequence
  Chain A, Crystal Structure Of A Glycoside Hydrolase Family 3 Beta-glucosidase, Bgl1 From Hypocrea Jecorina At 2.1a Resolution713 aa protein 3ZZ1_A GI:429544273
VVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 366 - protein, 713 aa, Artificial Sequence; identical to SEQ ID NO: 365
  Chain A, Crystal Structure Of A Glycoside Hydrolase Family 3 Beta-glucosidase, Bgl1 From Hypocrea Jecorina At 2.1a Resolution 713 aa protein 3ZYZ_A GI:429544272

SEQ ID NO: 367 - protein, 714 aa, Artificial Sequence
  Chain B, Crystal Structure Of Beta-d-glucoside Glucohydrolase From Trichoderma Reesei 714 aa protein 4I8D_B GI:430801090
AVVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 368 - protein, 714 aa, Artificial Sequence; identical to SEQ ID NO: 367
  Chain A, Crystal Structure Of Beta-d-glucoside Glucohydrolase From Trichoderma Reesei 714 aa protein 4I8D_A GI:430801089

SEQ ID NO: 369 - protein, 700 aa, Artificial Sequence
  Cel3d [Trichoderma reesei] 700 aa protein AAP57759.1 GI:31747172
MILGCESTGVISAVKHFVANDQEHERRAVDCLITQRALREVYLRPFQIVARDARPGALMTSYNKVNGKHVADSAEFLQGILRTEWNWDPLIVSDWYGTYTTIDAIKAGLDLEMPGVSRYRGKYIESALQARLLKQSTIDERARRVLRFAQKASHLKVSEVEQGRDFPEDRVLNRQICGSSIVLLKNENSILPLPKSVKKVALVGSHVRLPAISGGGSASLVPYYAISLYDAVSEVLAGATITHEVGAYAHQMLPVIDAMISNAVIHFYNDPIDVKDRKLLGSENVSSTSFQLMDYNNIPTLNKAMFWGTLVGEFIPTATGIWEFGLSVFGTADLYIDNELVIENTTHQTRGTAFFGKGTTEKVATRRMVAGSTYKLRLEFGSANTTKMETTGVVNFGGGAVHLGACLKVDPQEMIARAVKAAADADYTIICTGLSGEWESEGFDRPHMDLPPGVDTMISQVLDAAPNAVVVNQSGTPVTMSWAHKAKAIVQAWYGGNETGHGISDVLFGNVNPSGKLSLSWPVDVKHNPAYLNYASVGGRVLYGEDVYVGYKFYDKTEREVLFPFGHGLSYATFKLPDSTVRTVPETFHPDQPTVAIVKIKNTSSVPGAQVLQLYISAPNSPTHRPVKELHGFEKVYLEAGEEKEVQIPIDQYATSFWDEIESMWKSERGIYDVLVGFSSQEISGKGKLIVPETRFWMGL

SEQ ID NO: 370 - protein, 833 aa, Artificial Sequence
  Cel3c[Trichoderma reesei] 833 aa protein AAP57756.1 GI:31747168
MADIDVEAILKKLTLAEKVDLLAGIDFWHTKALPKHGVPSLRFTDGPNGVRGTKFFNGVPAACFPCGTSLGSTFNQTLLEEAGKMMGKEAIAKSAHVILGPTINMQRSPLGGRGFESIGEDPFLAGLGAAALIRGIQSTGVQATIKHFLCNDQEDRRMMVQSIVTERALREIYALPFQIAVRDSQPGAFMTAYNGINGVSCSENPKYLDGMLRKEWGWDGLIMSDWYGTYSTTEAVVAGLDLEMPGPPRFRGETLKFNVSNGKPFIHVIDQRAREVLQFVKKCAASGVTENGPETTVNNTPETAALLRKVGNEGIVLLKNENNVLPLSKKKKTLIVGPNAKQATYHGGGSAALRAYYAVTPFDGLSKQLETPPSYTVGAYTTVPPILGEQCLTPDGAPGMRWRVFNEPPGTPNRQHIDELFFTKTDMHLVDYYHPKAADTWYADMEGTYTADEDCTYELGLVVCGTAKAYVDDQLVVDNATKQVPGDAFFGSATREETGRINLVKGNTYKFKIEFGSAPTYTLKGDTIVPGHGSLRVGGCKVIDDQAEIEKSVALAKEHDQVIICAGLNADWETEGADRASMKLPGVLDQLIADVAAANPNTVVVMQTGTPEEMPWLDATPAVIQAWYGGNETGNSIADVVFGDYNPSGKLSLSFPKRLQDNPAFLNFRTEAGRTLYGEDVYVGYRYYEFADKDVNFPFGHGLSYTTFAFSNLSVSHKDGKLSVSLSVKNTGSVPGAQVAQLYVKPLQAAKINRPVKELKGFAKVELQPGETKAVTIEEQEKYVAAYFDEERDQWCVEKGDYEVIVSDSSAAKDGVALRGKFTVGETYWWSGV

SEQ ID NO: 371 - protein, 874 aa, Artificial Sequence
  Cel3b [Trichoderma reesei] 874 aa protein AAP57755.1 GI:31747166
MKTLSVFAAALLAAVAEANPYPPPHSNQAYSPPFYPSPWMDPSAPGWEQAYAQAKEFVSGLTLLEKVNLTTGVGWMGEKCVGNVGTVPRLGMRSLCMQDGPLGLRFNTYNSAFSVGLTAAASWSRHLWVDRGTALGSEAKGKGVDVLLGPVAGPLGRNPNGGRNVEGFGSDPYLAGLALADTVTGIQNAGTIACAKHFLLNEQEHFRQVGEANGYGYPITEALSSNVDDKTIHEVYGWPFQDAVKAGVGSFMCSYNQVNNSYACQNSKLINGLLKEEYGFQGFVMSDWQAQHTGVASAVAGLDMTMPGDTAFNTGASYFGSNLTLAVLNGTVPEWRIDDMVMRIMAPFFKVGKTVDSLIDTNFDSWTNGEYGYVQAAVNENWEKVNYGVDVRANHANHIREVGAKGTVIFKNNGILPLKKPKFLTVIGEDAGGNPAGPNGCGDRGCDDGTLAMEWGSGTTNFPYLVTPDAALQSQALQDGTRYESILSNYAISQTQALVSQPDAIAIVFANSDSGEGYINVDGNEGDRKNLTLWKNGDDLIKTVAAVNPKTIVVIHSTGPVILKDYANHPNISAILWAGAPGQESGNSLVDILYGKQSPGRTPFTWGPSLESYGVSVMTTPNNGNGAPQDNFNEGAFIDYRYFDKVAPGKPRSSDKAPTYEFGFGLSWSTFKFSNLHIQKNNVGPMSPPNGKTIAAPSLGSFSKNLKDYGFPKNVRRIKEFIYPYLSTTTSGKEASGDAHYGQTAKEFLPAGALDGSPQPRSAASGEPGGNRQLYDILYTVTATITNTGSVMDDAVPQLYLSHGGPNEPPKVLRGFDRIERIAPGQSVTFKADLTRRDLSNWDTKKQQWVITDYPKTVYVGSSSRDLPLSARLP

SEQ ID NO: 372 - protein, 744 aa, Artificial Sequence
  beta-D-glucoside glucohydrolase [Trichoderma reesei] 744 aa protein AAA18473.1 GI:493580
MRYRTAAALALATGPFARADSHSTSGASAEAVVPPAGTPWGTAYDKAKAALAKLNLQDKVGIVSGVGWNGGPCVGNTSPASKISYPSLCLQDGPLGVRYSTGSTAFTPGVQAASTWDVNLIRERGQFIGEEVKASGIHVILGPVAGPLGKTPQGGRNWEGFGVDPYLTGIAMGQTINGIQSVGVQATAKHYILNEQELNRETISSNPDDRTLHELYTWPFADAVQANVASVMCSYNKVNTTWACEDQYTLQTVLKDQLGFPGYVMTDWNAQHTTVQSANSGLDMSMPGTDFNGNNRLWGPALTNAVNSNQVPTSRVDDMVTRILAAWYLTGQDQAGYPSFNISRNVQGNHKTNVRAIARDGIVLLKNDANILPLKKPASIAVVGSAAIIGNHARNSPSCNDKGCDDGALGMGWGSGAVNYPYFVAPYDAINTRASSQGTQVTLSNTDNTSSGASAARGKDVAIVFITADSGEGYITVEGNAGDRNNLDPWHNGNALVQAVAGANSNVIVVVHSVGAIILEQILALPQVKAVVWAGLPSQESGNALVDVLWGDVSPSGKLVYTIAKSPNDYNTRIVSGGSDSFSEGLFIDYKHFDDANITPRYEFGYGLSYTKFNYSRLSVLSTAKSGPATGAVVPGGPSDLFQNVATVTVDIANSGQVTGAEVAQLYITYPSSAPRTPPKQLRGFAKLNLTPGQSGTATFNIRRRDLSYWDTASQKWVVPSGSFGISVGASSRDIRLTSTLSVA

SEQ ID NO: 373 - protein, 862 aa, Artificial Sequence
  putative beta-glucosidase 1 precursor [Trichoderma reesei RUT C-30] 862 aa protein ETS02983.1 GI:572279864
MTSFHDGVKLSTVTYGYYVPPYYPAPYGGWVEDWQESYTKAKALVDSMTLAEKTNITAGTGIYMGEWRCAGNTGSAFRVSFPQLCLNDSPAGVRHADNVTAFPDGITVGATFDKALMYKRGVAIGKENRGKGVNVWLGPTVGPIGRKPKGGRNWEGFGADPVLQAVGARETIKGVQEQGVIATIKHFIGNEQEMYRMYNPFQYAYSSNIDDRTLHEVYAWPFAEGIRAGVGAVMMAYNAVNGTACSQHPYLMSALLKDEMGFQGFIMTDWLAHMSGVASAIAGLDMDMPGDVQIPFFGGSYWMYELTRSALNGSVPMDRINDAATRIAAAWYKMGQDKGFPATNFDTNSRAAFNPLYPAALPLSPFGITNEFVPVQDDHDVIARQISQEAITLLKNDGDILPLSPSQHLKVFGTDAQKNPDGINSCTDRNCNKGTLGQGWGSGTVDYPYLDDPISAITAEADNVTFYNTDKFPSVGEVSDSDVAIVFVNSDAGENTYTVEGNHGDRDKSGLYAWHDGDKLVQDAASKFSNVIVVIHTVGPLILEKWIDLPSVKAVLVAHLPGQEAGKSLTNVLFGHASPCGHLPYSITKEEDDLPKSVTTLIDSEFLNQPQDTYTEGLYIDYRWLNKNKTKPRYAFGHGLSYTNFTFKAASIKQVARLSAYPPARPAKGSTPDFAQSIPSASEAVAPSGFGKIPRYIYSWLSQGDANRAISDGKTGKYPYPDGYSTTQKPGARAGGGEGGNPALWDVAYSLTVTVQNTGDEYAGKASVQAYLQFPDDIDYDTPIIQLRDFEKTKELKPGETTTVTLTLTRKDVSVWDVVAQDWKVPAVDGGYKVWIGDASDSLSIVCHTDTLECETGVVGPV

SEQ ID NO: 374 - protein, 781 aa, Artificial Sequence
  Putative beta-glucosidase [Trichoderma reesei RUT C-30] 781 aa protein ETS01786.1 GI:572278616
MVAVKQIALLAGLAHWADAAEKVITNDTHFYGQSPPVYPSPEMTGGNEWEAAYQKAKAFVGQLTLEEKVNLTAGVPPNTTCSGVIPAIERLKFPGMCLSDAGNGLRNTDFVSGFPSGIHVGASWSKDLAFRRAVAMGAEFRKKGVNVLLGPVVGPAGRTVRGGRNWEGFSVDPWLAGVLVSETVSGIQEQGVITSTKHYILNEQETHRMPEANVSAVSSNIDDKTMHEYYLWPFQDAVRAGSGNIMCSYQRINNSYGCSNSKTLNGLLKTELGFQGFVVSDWSAQHAGVASAEAGMDMAMPGPAEFWGEHLVEAVKNGSLPESRITDMATRIIATWYQFDQDNGIPKPGIGMPSNVLDSHEIVDARDPAAVPVLLNGAIEGHVLVKNTKNTLPLKKPRKLSLFGYSATTPDFFSPSRDEQLSDSWIFGKEAYNSNYLSPDGFATFGRNGTTFGGCGSGAITPALAISPFEALKWRAAQDGTATFNNFLSDKPDVDPTSDACIVFGNAYACEGNDRPAIQDDYTDDLIKAVASQCNKTIVVLHNAGIRLVDGFVDHPNITAVIFAHLPGQESGPALTSLLYGETSPSGRLPYTVAKNDTDYGVVLDPAQATGEFAYFPQADFKEGVYLDYRYFDKEGIEPRYEFGFGLSYTTFAYLNLSVDHVSGANTYPWPGGPIVSGGQTDLWDAIATVSVDIRNTGSVASYEVAQLYIGIPGAPAKQLRGFEKPFLRPNESQSVTFHLTRRDLSVWSVERQKWQLQQGTYKIYVGSSSRRLHVNGTLDI

SEQ ID NO: 375 - protein, 457 aa, Artificial Sequence
  predicted protein, partial [Trichoderma reesei QM6a] 457 aa protein EGR51923.1 GI:340521689
HLRSHTVESPNSIVKRGTCAFPTDDPNLVAVTPDAENAGWAMSPDQPCKPGHYCPIACKPGMVMAQWSPDSSYSYPSSMDGGLYCDEDGEVHKPFPNKPYCVEGTGAVVAVNKCGEPMSWCQTVLPGNEAMLIPTLVEDQATIAVPDTSYWCETAAHYYINPPGSSVADCVWGVSSKPVGNWSPYVAGANTDGDGNTFVKLGWNPIWQDSALKSTLPSFGVKIECPDGGCNGLPCEISPNSDGSVDSKESAVGAGNAAFCVVTVPKGGVANIVAYNVDGSSGGSDSDSDSDSGSSSSAAPSSTAHGLKAGGFAALAEKPTSTTAAPSSTEVSTTAAASTTEVASTTAAAESTTTAAESTAAETTDASATATTKAAHSTTGGKASSTARARPSVNPGMFHENGTSPHQTTAAPSGPSATQADSAPVTTTTKKGEAGRQQGSTAFAGLIVAFVAAACFL

SEQ ID NO: 376 - protein, 781 aa, Artificial Sequence; identical to SEQ ID NO: 374
  glycoside hydrolase family 3 [Trichoderma reesei QM6a]  781 aa protein EGR50829.1 GI:340520593

SEQ ID NO: 377 - protein, 436 aa, Artificial Sequence
  cell wall protein [Trichoderma reesei QM6a] 436 aa protein EGR50785.1 GI:340520549
MLACITRATLPTVVAATPSHHHHHAHRHAKKHAAARVEKRAPDVVTEVVVGATATVFELDGKIVDAATAKAGLAEGEYIIVGETTPTFVPPPPPPPATSSAAPLRAQFVEEPISSPAAPTTTSAPPPPPTTTAQATTSSAPPPPKTSKPAQSSPSSGATGLDADFPSGKISCKTFPSEYGAVALDWLGTGGWSGLQFVPNYSPDAQSISDIITGIAGQTCSKGAMCSYACPPGYQKTQWPKAQGATLQSIGGLYCNEDGFLELTRPDHPKLCEAGAGGVTIKNDLDDSVCTCRTDYPGIESMVIPACTSAGETIELTNPDETDYYVWDGKTTSAQYYVNKKGYAVEDACVWNSPLDPRGAGNWSPINIGTGKTADGITWLSIFENLPTSSAKLDFNIEITGDVNSKCSYIDGAWTGGDKGCTTAMPSGGKAVIRYF

SEQ ID NO: 378 - protein, 700 aa, Artificial Sequence; identical to SEQ ID NO: 369
  glycoside hydrolase family 3 [Trichoderma reesei QM6a] 700 aa protein EGR49878.1 GI:340519640

SEQ ID NO: 379 - protein, 744 aa, Artificial Sequence; identical to SEQ ID NO: 372
  glycoside hydrolase family 3 [Trichoderma reesei QM6a] 744 aa protein EGR49703.1 GI:340519465

SEQ ID NO: 380 - protein, 814 aa, Artificial Sequence
  glycoside hydrolase family 3 [Trichoderma reesei QM6a] 814 aa protein EGR49559.1 GI:340519320
MTLAEKTNITAGTGIYMGERCAGNTGSAFRVSFPQLCLNDSPAGVRHADNVTAFPDGITVGATFDKALMYKRGVAIGKENRGKGVNVWLGPTVGPIGRKPKGGRNWEGFGADPVLQAVGARETIKGVQEQGVIATIKHFIGNEQEMYRMYNPFQYAYSSNIDDRTLHEVYAWPFAEGIRAGVGAVMMAYNAVNGTACSQHPYLMSALLKDEMGFQGFIMTDWLAHMSGVASAIAGLDMDMPGDVQIPFFGGSYWMYELTRSALNGSVPMDRINDAATRIAAAWYKMGQDKGFPATNFDTNSRAAFNPLYPAALPLSPFGITNEFVPVQDDHDVIARQISQEAITLLKNDGDILPLSPSQHLKVFGTDAQKNPDGINSCTDRNCNKGTLGQGWGSGTVDYPYLDDPISAITAEADNVTFYNTDKFPSVGEVSDSDVAIVFVNSDAGENTYTVEGNHGDRDKSGLYAWHDGDKLVQDAASKFSNVIVVIHTVGPLILEKWIDLPSVKAVLVAHLPGQEAGKSLTNVLFGHASPCGHLPYSITKEEDDLPKSVTTLIDSEFLNQPQDTYTEGLYIDYRWLNKNKTKPRYAFGHGLSYTNFTFKAASIKQVARLSAYPPARPAKGSTPDFAQSIPSASEAVAPSGFGKIPRYIYSWLSQGDANRAISDGKTGKYPYPDGYSTTQKPGARAGGGEGGNPALWDVAYSLTVTVQNTGDEYAGKASVQAYLQFPDDIDYDTPIIQLRDFEKTKELKPGETTTVTLTLTRKDVSVWDVVAQDWKVPAVDGGYKVWIGDASDSLSIVCHTDTLECETGVVGPV

SEQ ID NO: 381 - protein, 874 aa, Artificial Sequence
  glycosidehydrolase family 3 [Trichoderma reesei QM6a] 874 aa protein EGR48517.1 GI:340518276
MKTLSVFAAALLAAVAEANPYPPPHSNQAYSPPFYPSPWMDPSAPGWEQAYAQAKEFVSGLTLLEKVNLTTGVGWMGEKCVGNVGTVPRLGMRSLCMQDGPLGLRFNTYNSAFSVGLTAAASWSRHLWVDRGTALGSEAKGKGVDVLLGPVAGPLGRNPNGGRNVEGFGSDPYLAGLALADTVTGIQNAGTIACAKHFLLNEQEHFRQVGEANGYGYPITEALSSNVDDKTIHEVYGWPFQDAVKAGVGSIMCSYNQVNNSYACQNSKLINGLLKEEYGFQGFVMSDWQAQHTGVASAVAGLDMTMPGDTAFNTGASYFGSNLTLAVLNGTVPEWRIDDMVMRIMAPFFKVGKTVDSLIDTNFDSWTNGEYGYVQAAVNENWEKVNYGVDVRANHANHIREVGAKGTVIFKNNGILPLKKPKFLTVIGEDAGGNPAGPNGCGDRGCDDGTLAMEWGSGTTNFPYLVTPDAALQSQALQDGTRYESILSNYAISQTQALVSQPDAIAIVFANSDSGEGYINVDGNEGDRKNLTLWKNGDDLIKTVAAVNPKTIVVIHSTGPVILKDYANHPNISAILWAGAPGQESGNSLVDILYGKQSPGRTPFTWGPSLESYGVSVMTTPNNGNGAPQDNFNEGAFIDYRYFDKVAPGKPRSSDKAPTYEFGFGLSWSTFKFSNLHIQKNNVGPMSPPNGKTIAAPSLGSFSKNLKDYGFPKNVRRIKEFIYPYLSTTTSGKEASGDAHYGQTAKEFLPAGALDGSPQPRSAASGEPGGNRQLYDILYTVTATITNTGSVMDDAVPQLYLSHGGPNEPPKVLRGFDRIERIAPGQSVTFKADLTRRDLSNWDTKKQQWVITDYPKTVYVGSSSRDLPLSARLP

SEQ ID NO: 382 - protein, 932 aa, Artificial Sequence
  glycosidehydrolase family 3 [Trichoderma reesei QM6a] 932 aa protein EGR47352.1 GI:340517106
MANSIGGSSADKFDLDPLWQNLDWAIGQMMLMGWDGTQVTPQIRSLIEDHHLGSIILTAKNLKSAHHTALLVQELQMIAKNSGHPQPLLIAVDQENGGVNSLFDEDFVCQFPSAMAIAATGSLELSYEVNKATATEISACGVNLMLGPVLDVLNNARYQVIGVRASGDDPQEVSQYGLAALSGIRDAGVASCGKHFPSYGNLDFLGSNLDVPIITQTLEELSLSALVPFRNAIASGKLDAMFIGGCGISNPSMNVSHACLSDQVVDDLLRNELGFKGVAISECLEMEALSQDLGVQNGVVMAVEAGCDIVLLCRAYDVQLEAIKGLKLGYENGIITKERIFTSLKRIFHLKSTCTSWAKALNPPGINLLSQIRPSHLALSRRAYDDSITIVRDKEKLLPLSLSMHPGEELLLLTPLVKPLPASSLTKSLLESKNDPSLVSTEHDRWNHQIRERSAIMSGEGVFREFGKTLARYRNEKLLHTSYTANGVRPVHENLINRASCIIIFTADANRNLYQAGFTKHVDMMCSMLRSRGQKKQLIVVAVSSPYDFAMDKSIGTYICTYDFTENAMAALVRALVGDSNPVGTMPGTLRKSKKVLKSRQHWLVEEFDSSRDRKGLNDLIRAVHRASDQDFRYLQTATADTFLLANQNIKETHFVVRNSSTQALYGFAATYFVQNVGILGALIVDPTKRNMSIGRSLHRRAIKSLTQQRGIKKVQLGSCFPALFLGIPLDIEVTTTKEWFSNSGWDTQFPRRLTNMVIQDLSAWYAPEGLSQSIQRANISFDLIYGVESGDTVMHHVRTHANPEVLELYRTALEESKACGIVRAKDAAGNLLGTIIICRPNSPLARYVPPLVSLGQDIGGLLAPIVPPAPLSTLVLQGLALMGVRQNKGHKATKSVLSWVVDDAYEPLVAMGFDVLQAFEEITNSPETFQT

SEQ ID NO: 383 - protein, 890 aa, Artificial Sequence
  carbohydrate esterase family 4 [Trichoderma reesei QM6a] 890 aa protein EGR46266.1 GI:340516015
MLPRRMRKSRCCIAVLAVIAIIVMLLAAAGAFGYKKLKITPLDGKSPPWYPTPKGGSVRQWADSYQKAAEMVARMTLPEKVNITTGTGWSMGLAVGNTAPALLVGFPALALQDGPLGIRFADNATALPAGVTVGATWNRHLMYEHGRVHALEARGKGINALLGPCVGPLGRMPAGGRNWEGFGADPYLQGVAGYETIKGIQDQGVMATIKHFVANEQEHFRQAWEWVLPNALSSNIDDRTMHEIYAWPFGDAVKAGVASVMCSYNMVNNSYACGNSKLLNGILKDELGFQGFVMSDWLAQRSGVGSALAGLDMSMPGDGLRWQDGNSLWGPNLSRAVLNGSLPLERLNDMVVRIVAAWYQLGQDDEKLFDRKGPNFSSWTNDRMGVTAPASSSPQEKVVVNQFVNVQANHSILARQIAAEGTVLLKNEGVLPLSVDGLLGGGGGSNSTKREGQVRIGIFGEDAGPGKGPNYCEDRSCNQGTLASGWGSGAVEFPYLVSPIEALRKKFNKDKVKLTEHLKNDELDTGVIKSQDICMVFINSDSGEGYRAWEGVRGDRNDLKPQKGGVGLVTHVGLNCGNGSGTTIVVLHSVGPVVVDPWIDMPGIKALISANLPGQESGNALASILFGEENPSGKLPYTVGKSLSDYGPGGQVMYLPNGAVPQQDFSEGLYIDYRHFDKFNIEPRYEFGFGLSYTNFDYKNLKITETKPRSPLPDERPAAEVEPPSFDTTIPQAEEALFPSGIRRLKKYVYPYIESVKDIKEGQYSYPDGYDKEQPLSGAGGGEGGNPSLWDSHVIVSVEVTNTGKLGGKAVPQLYLSYPASETVDFPVRVLRGFDKVYIGKGETKTVEFSLTRRDLSYWDVERQNWVIPEGEYTFAVGESSRDLRVSGTW

SEQ ID NO: 384 - protein, 489 aa, Artificial Sequence
  glycosidehydrolase family 3, partial [Trichoderma reesei QM6a] 489 aa protein EGR44807.1 GI:340514546
QLFAVGFHGREINQEITTLIRDYGVGAIVLFKRNENGLVTRISPPIASQQPGPMTLGAAGSLEYAYEVAKATAEMLRYFGINMNYAPVGDVNSEPLNPVIGVRSPSDQAETVSKFAAACTKGLREHKVVPCIKHFPGHGDTAVDSHYGLPVINKSRADMEKLELIPFRDAVADNIEMVMTAHISLPQLAKDGLPATLSPDTIGILRNEWKYEGVIMTDCLEMDGIRATYGTVEGSLMAFQAGVDNVMICHTFDVQAAAVDYICGAIESGKLSQERVDQSLERLRKLKERYTNWDIALHAEPPEALEAINERGEKLARQVYADATTLVRAQEGLLPLKATAKIAFVSPGPDVPIGGAVDSGTLPTRVPWIADTFGEQIRKRAPEMSDVRFTSSNLTEEQWEQIDEADVVILATRNARESKYQKELGLEVAKRRGSRPLISIATCAPYDFLDDEEIRTYIAVYEPTVEAFSAAVDILFGDAQPRGKLPVAH

SEQ ID NO: 385 - protein, 834 aa, Artificial Sequence
  glycosidehydrolase family 3 [Trichoderma reesei QM6a] 834 aa protein EGR44527.1 GI:340514262
MADIDVEAILKKLTLAEKVDLLAGIDFWHTKALPKHGVPSLRFTDGPNGVRGTKFFNGVPAACFPCGTSLGSTFNQTLLEEAGKMMGKEAIAKSAHVILGPTINMQRSPLGGRGFESIGEDPFLAGLGAAALIRGIQSTGVQATIKHFLCNDQEDRRMMVQSIVTERALREIYALPFQIAVRDSQPGAFMTAYNGINGVSCSENPKYLDGMLRKEWGWDGLIMSDWYGTYSTTEAVVAGLDLEMPGPPRFRGETLKFNVSNGKPFIHVIDQRAREVLQFVKKCAASGVTENGPETTVNNTPETAALLRKVGNEGIVLLKNENNVLPLSKKKKTLIVGPNAKQATYHGGGSAALRAYYAVTPFDGLSKQLETPPSYTVGAYTHRFLPILGEQCLTPDGAPGMRWRVFNEPPGTPNRQHIDELFFTKTDMHLVDYYHPKAADTWYADMEGTYTADEDCTYELGLVVCGTAKAYVDDQLVVDNATKQVPGDAFFGSATREETGRINLVKGNTYKFKIEFGSAPTYTLKGDTIVPGHGSLRVGGCKVIDDQAEIEKSVALAKEHDQVIICAGLNADWETEGADRASMKLPGVLDQLIADVAAANPNTVVVMQTGTPEEMPWLDATPAVIQAWYGGNETGNSIADVVFGDYNPSGKLSLSFPKRLQDNPAFLNFRTEAGRTLYGEDVYVGYRYYEFADKDVNFPFGHGLSYTTFAFSNLSVSHKDGKLSVSLSVKNTGSVPGAQVAQLYVKPLQAAKINRPVKELKGFAKVELQPGETKAVTIEEQEKYVAAYFDEERDQWCVEKGDYEVIVSDSSAAKDGVALRGKFTVGETYWWSGV

SEQ ID NO: 386 - protein, 834 aa, Artificial Sequence; identical to SEQ ID NO: 385
  glycoside hydrolase family 3 [Trichoderma reesei QM6a] 834 aa protein XP_006969529.1 GI:589115013

SEQ ID NO: 387 - protein, 489 aa, Artificial Sequence; identical to SEQ ID NO: 384
  glycoside hydrolase family 3, partial [Trichoderma reesei QM6a] 489 aa protein XP_006969215.1 GI:589114385

SEQ ID NO: 388 - protein, 860 aa, Artificial Sequence
  carbohydrate esterase family 4 [Trichoderma reesei QM6a] 890 aa protein XP_006967911.1 GI:589111777
MLPRRMRKSRCCIAVLAVIAIIVMLLAAAGAFGYKKLKITPLDGKSPPWYPTPKGGSVRQWADSYQKAAEMVARMTLPEKVNITTGTGWSMGLAVGNTAPALLVGFPALALQDGPLGIRFADNATALPAGVTVGATWNRHLMYEHGRVHALEARGKGINALLGPCVGPLGRMPAGGRNWEGFGADPYLQGVAGYETIKGIQDQGVMATIKHFVANEQEHFRQAWEWVLPNALSSNIDDRTMHEIYAWPFGDAVKAGVASVMCSYNMVNNSYACGNSKLLNGILKDELGFQGFVMSDWLAQRSGVGSALAGLDMSMPGDGLRWQDGNSLWGPNLSRAVLNGSLPLERLNDMVVRIVAAWYQLGQDDEKLFDRKGPNFSSWTNDRMGVTAPASSSPQEKVVVNQFVNVQANHSILARQIAAEGTVLLKNEGVLPLSVDGLLGGGGGSNSTKREGQVRIGIFGEDAGPGKGPNYCEDRSCNQGTLASGWGSGAVEFPYLVSPIEALRKKFNKDKVKLTEHLKNDELDTGVIKSQDICMVFINSDSGEGYRAWEGVRGDRNDLKPQKGGVGLVTHVGLNCGNGSGTTIVVLHSVGPVVVDPWIDMPGIKALISANLPGQESGNALASILFGEENPSGKLPYTVGKSLSDYGPGGQVMYLPNGAVPQQDFSEGLYIDYRHFDKFNIEPRYEFGFGLSYTNFDYKNLKITETKPRSPLPDERPAAEVEPPSFDTTIPQAEEALFPSGIRRLKKYVYPYIESVKDIKEGQYSYPDGYDKEQPLSGAGGGEGGNPSLWDSHVIVSVEVTNTGKLGGKAKGETKTVEFSLTRRDLSYWDVERQNWVIPEGEYTFAVGESSRDLRVSGTW

SEQ ID NO: 389 - protein, 932 aa, Artificial Sequence; identical to SEQ ID NO: 382
  glycoside hydrolase family 3 [Trichoderma reesei QM6a] 932 aa protein XP_006966911.1 GI:589109777

SEQ ID NO: 390 - protein, 874 aa, Artificial Sequence; identical to SEQ ID NO: 381
  glycoside hydrolase family 3 [Trichoderma reesei QM6a] 874 aa protein XP_006965281.1 GI:589106517

SEQ ID NO: 391 - protein, 814 aa, Artificial Sequence; identical to SEQ ID NO: 380
  glycoside hydrolase family 3 [Trichoderma reesei QM6a] 814 aa protein XP_006964430.1 GI:589104815

SEQ ID NO: 392 - protein, 744 aa, Artificial Sequence; identical to SEQ ID NO: 372
  glycoside hydrolase family 3 [Trichoderma reesei QM6a] 744 aa protein XP_006964076.1 GI:589104107

SEQ ID NO: 393 - protein, 700 aa, Artificial Sequence; identical to SEQ ID NO: 369
  glycoside hydrolase family 3 [Trichoderma reesei QM6a] 700 aa protein XP_006964050.1 GI:589104055

SEQ ID NO: 394 - protein, 781 aa, Artificial Sequence; identical to SEQ ID NO: 374
  glycoside hydrolase family 3 [Trichoderma reesei QM6a] 781 aa protein XP_006963375.1 GI:589102705

SEQ ID NO: 395 - protein, 436 aa, Artificial Sequence; identical to SEQ ID NO: 377
  cell wall protein [Trichoderma reesei QM6a] 436 aa protein XP_006963339.1 GI:589102633

SEQ ID NO: 396 - protein, 457 aa, Artificial Sequence; identical to SEQ ID NO: 375
  predicted protein, partial [Trichoderma reesei QM6a] 457 aa protein XP_006962014.1 GI:589099983

SEQ ID NO: 397 - protein, 456 aa, Artificial Sequence
  hypothetical protein M419DRAFT_70331 [Trichoderma reesei RUT C-30] 456 aa protein ETS05514.1 GI:572282500
MKVTDVQAALASAVVLLSLPAGSVASSHKRFHQLPNKKHTHLRSHTVESPNSIVKRGTCAFPTDDPNLVAVTPDAENAGWAMSPDQPCKPGHYCPIACKPGMVMAQWSPDSSYSYPSSMDGGLYCDEDGEVHKPFPNKPYCVEGTGAVVAVNKCGEPMSWCQTVLPGNEAMLIPTLVEDQATIAVPDTSYWCETAAHYYINPPGSSVADCVWGVSSKPVGNWSPYVAGANTDGDGNTFVKLGWNPIWQDSALKSTLPSFGVKIECPDGGCNGLPCEISPNSDGSVDSKESAVGAGNAAFCVVTVPKGGVANIVAYNKPTSTTAAPSSTEVSTTAAASTTEVASTTAAAESTTTAAESTAAETTDASATATTKAAHSTTGGKASSTARARPSVNPGMFHENGTSPHQTTAAPSGPSATQADSAPVTTTTKKGEAGRQQGSTAFAGLIVAFVAAACFL

SEQ ID NO: 398 - protein, 744 aa, Artificial Sequence; identical to SEQ ID NO: 372
  beta-D-glucoside glucohydrolase I [Trichoderma reesei RUT C-30] 744 aa protein ETS03194.1 GI:572280097

SEQ ID NO: 399 - protein, 700 aa, Artificial Sequence; identical to SEQ ID NO: 369
  hypotheticalprotein M419DRAFT_122639 [Trichoderma reesei RUT C-30] 700 aa protein ETS03170.1 GI:572280073

SEQ ID NO: 400 - protein, 436 aa, Artificial Sequence; identical to SEQ ID NO: 377
  SUN-domain-containing protein [Trichoderma reesei RUT C-30] 436 aa protein ETS01671.1 GI:572278501

SEQ ID NO: 401 - protein, 874 aa, Artificial Sequence; identical to SEQ ID NO: 381
  hypotheticalprotein M419DRAFT_25095 [Trichoderma reesei RUT C-30] 874 aa protein ETS01349.1 GI:572278157

SEQ ID NO: 402 - protein, 932 aa, Artificial Sequence; identical to SEQ ID NO: 382
  beta-N-acetylglucosaminidase[Trichoderma reesei RUT C-30] 932 aa protein ETS00749.1 GI:572277491

SEQ ID NO: 403 - protein, 890 aa, Artificial Sequence; identical to SEQ ID NO: 383
  hypothetical protein M419DRAFT_86704 [Trichoderma reesei RUT C-30] 890 aa protein ETR99336.1 GI:572275968

SEQ ID NO: 404 - protein, 533 aa, Artificial Sequence
  putative beta-N-acetylglucosaminidase [Trichoderma reesei RUT C-30] 533 aa protein ETR97676.1 GI:572274120
MPSPEQRRKIGQLFAVGFHGREINQEITTLIRDYGVGAIVLFKRNVLDAAQLQALCLGLQKIARDAGHNQPLFIGIDQENGLVTRISPPIASQQPGPMTLGAAGSLEYAYEVAKATAEMLRYFGINMNYAPVGDVNSEPLNPVIGVRSPSDQAETVSKFAAACTKGLREHKVVPCIKHFPGHGDTAVDSHYGLPVINKSRADMEKLELIPFRDAVADNIEMVMTAHISLPQLAKDGLPATLSPDTIGILRNEWKYEGVIMTDCLEMDGIRATYGTVEGSLMAFQAGVDNVMICHTFDVQAAAVDYICGAIESGKLSQERVDQSLERLRKLKERYTNWDIALHAEPPEALEAINERGEKLARQVYADATTLVRAQEGLLPLKATAKIAFVSPGPDVPIGGAVDSGTLPTRVPWIADTFGEQIRKRAPEMSDVRFTSSNLTEEQWEQIDEADVVILATRNARESKYQKELGLEVAKRRGSRPLISIATCAPYDFLDDEEIRTYIAVYEPTVEAFSAAVDILFGDAQPRGKLPVAH

SEQ ID NO: 405 - protein, 396 aa, Artificial Sequence
  UDP-glycotransferase (338)
MGHKHIAIFNIPAHGHINPTLALTASLVKRGYRVTYPVTDEFVKAVEETGAEPLNYRSTLNIDPQQIRELMKNKKDMSQAPLMFIKEMEEVLPQLEALYENDKPDLILFDFMAMAGKLLAEKFGIEAVRLCSTYAQNEHFTFRSISEEFKIELTPEQEDALKNSNLPSFNFEDMFEPAKLNIVFMPRAFQPYGETFDERFSFVGPSLAKRKFQEKETPIISDSGRPVMLISLGTAFNAWPEFYHMCIEAFRDTKWQVIMAVGTTIDPESFDDIPENFSIHQRVPQLEILKKAELFITHGGMNSTMEGLNAGVPLVAVPQMPEQEITARRVEELGLGKHLQPEDTTAASLREAVSQTDGDPHVLKRIQDMQKHIKQAGGAEKAADEIEAFLAPAGVK

SEQ ID NO: 406 - DNA, 1191 bp, Artificial Sequence
  338 (gDNA, native)
atgggacataaacatatcgcgatttttaatattccggctcacggccatattaatccaacgctagctttaacggcaagccttgtcaaacgcggttatcgggtaacatatccggtgacggatgagtttgtgaaggctgttgaggaaactggggcagagccgctcaactaccgctcaactttaaatatcgatccgcagcaaattcgggagctgatgaaaaataaaaaagatatgtcgcaggctccgctgatgtttatcaaagaaatggaggaggttcttcctcagcttgaagcgctctatgagaatgacaagccagaccttatcctttttgactttatggccatggcgggaaaactgctggctgagaagtttggaatagaggcggtccgcctttgttctacatatgcacagaacgaacattttacattcagatccatttctgaagagtttaagatcgagctgacgcctgagcaagaggatgctttgaaaaattcgaatcttccgtcatttaactttgaggatatgttcgagcctgcaaaattgaacattgtctttatgcctcgtgcttttcagccttacggcgaaacgtttgatgagcggttctcttttgttggtccttctcttgccaaacgcaagtttcaggaaaaagaaacgccgattatttcggacagcggccgtcctgtcatgctgatatctttagggacggcgttcaatgcctggccggaattttatcatatgtgcatagaagcattcagggacacgaagtggcaggttatcatggctgttggcacgacaatcgatcctgaaagctttgatgacatacctgagaacttttcgattcatcagcgcgttcctcagctggagatcctgaagaaagcggagctgttcatcacccatgggggtatgaacagtacgatggaagggttgaatgccggtgtaccgctcgttgccgttccgcaaatgcctgaacaggaaatcactgcccgccgcgtcgaagagcttgggcttggcaagcatttgcagccggaagacacaacagcagcttcactgcgggaagccgtctctcagacggatggtgacccgcatgtcctgaaacggatacaggacatgcaaaagcacattaaacaagccggaggggccgagaaagccgcagatgaaattgaggcatttttagcacccgcaggagtaaaataa

SEQ ID NO: 407 - protein, 469 aa, Artificial Sequence; identical to SEQ ID NO: 306
  301 UGT98

SEQ ID NO: 408 - DNA, 1419 bp, Artificial Sequence; identical to SEQ ID NO: 307
  301(gDNA, native)

SEQ ID NO: 409 - protein, 474 aa, Artificial Sequence; identical to SEQ ID NO: 18
  UDP-glycosyltransferases (339)

SEQ ID NO: 410 - DNA, 1425 bp, Artificial Sequence; identical to SEQ ID NO: 127
  339 (gDNA)

SEQ ID NO: 411 - protein, 469 aa, Artificial Sequence; identical to SEQ ID NO: 304
  330

SEQ ID NO: 412 - DNA, 1410 bp, Artificial Sequence; identical to SEQ ID NO: 305
  330 (gDNA, native)

SEQ ID NO: 413 - protein, 406 aa, Artificial Sequence
  UDP-glycosyltransferases (328) described in Itkin et al.
  VARIANT 153: Xaa = Any Amino Acid
MDAAQQGDTTTILMLPWLGYGHLSAFLELAKSLSRRNFHIYFCSTSVNLDAIKPKLPSSFSDSIQFVELHLPSSPEFPPHLHTTNGLPPTLMPALHQAFSMAAQHFESILQTLAPHLLIYDSLQPWAPRVASSLKIPAINFNTTGVFVISQGXHPIHYPHSKFPFSEFVLHNHWKAMYSTADGASTERTRKRGEAFLYCLHASCSVILINSFRELEGKYMDYLSVLLNKKVVPVGPLVYEPNQDGEDEGYSSIKNWLDKKEPSSTVFVSFGSEYFPSKEEMEEIAHGLEASEVNFIWVVRFPQGDNTSGIEDALPKGFLERAGERGMVVKGWAPQAKILKHWSTGGFVSHCGWNSVMESMMFGVPIIGVPMHVDQPFNAGLVEEAGVGVEAKRDPDGKIQRDEVAK

SEQ ID NO: 414 - DNA, 1359 bp, Artificial Sequence
  328 (gDNA, native)
atggatgctgcccaacaaggtgacaccacaaccattttgatgcttccatggctcggctatggccatctttcagcttttctcgagctggccaaaagcctctcaaggaggaacttccatatctacttctgttcaacctctgttaatcttgacgccattaaaccaaagcttccttcttctttctctgattccattcaatttgtggagctccatctcccttcttctcctgagttccctcctcatcttcacacaaccaacggccttccccctaccctcatgcccgctctccaccaagccttctccatggctgcccagcactttgagtccattttacaaacacttgccccgcaccttctcatttatgactctcttcaaccttgggctcctcgggtagcttcatccctcaaaattccggccatcaacttcaataccacgggagttttcgtcatttctcaagggyttcaccctattcactacccacattctaaattcccattctcagagttcgttcttcacaatcattggaaagccatgtactccactgccgatggagcttctaccgaaagaacccgcaaacgtggagaagcgtttctgtattgcttgcatgcttcttgtagtgtaattctaatcaatagtttcagagagctcgaggggaaatatatggattatctctctgttctcttgaacaagaaagttgttccggttggtcctttggtttacgaaccgaatcaagacggggaagatgaaggttattcaagcatcaaaaattggcttgacaaaaaggaaccgtcctccaccgtcttcgtgtcatttggaagcgaatacttcccgtcaaaggaagaaatggaagagatagcccatgggttagaggcgagcgaggttaatttcatctgggtcgttaggtttcctcaaggagacaacaccagcggcattgaagatgccttgccgaagggttttctggagagggcgggagagagagggatggtggtgaagggttgggctcctcaggcgaagatactgaagcattggagcacagggggattcgtgagccactgtggatggaactcggtgatggagagcatgatgtttggcgttcccataataggggttccgatgcatgtggaccagccctttaacgccggactcgtggaagaagctggcgtcggcgtggaggccaagcgagatccagacggcaaaattcaaagagacgaagttgcaaagttgatcaaagaagtggtggttgagaaaaccagagaagatgtgcggaagaaagcaagagaaatgagtgagattttgaggagcaagggagaggagaagtttgatgagatggtcgctgaaatttctctcttgcttaaaatatga

SEQ ID NO: 415 - protein, 828 aa, Artificial Sequence
  AtSus1
MKHHHHHHQLHAGAHAAAGTMANAERMITRVHSQRERLNETLVSERNEVLALLSRVEAKGKGILQQNQIIAEFEALPEQTRKKLEGGPFFDLLKSTQEAIVLPPWVALAVRPRPGVWEYLRVNLHALVVEELQPAEFLHFKEELVDGVKNGNFTLELDFEPFNASIPRPTLHKYIGNGVDFLNRHLSAKLFHDKESLLPLLKFLRLHSHQGKNLMLSEKIQNLNTLQHTLRKAEEYLAELKSETLYEEFEAKFEEIGLERGWGDNAERVLDMIRLLLDLLEAPDPCTLETFLGRVPMVFNVVILSPHGYFAQDNVLGYPDTGGQVVYILDQVRALEIEMLQRIKQQGLNIKPRILILTRLLPDAVGTTCGERLERVYDSEYCDILRVPFRTEKGIVRKWISRFEVWPYLETYTEDAAVELSKELNGKPDLIIGNYSDGNLVASLLAHKLGVTQCTIAHALEKTKYPDSDIYWKKLDDKYHFSCQFTADIFAMNHTDFIITSTFQEIAGSKETVGQYESHTAFTLPGLYRVVHGIDVFDPKFNIVSPGADMSIYFPYTEEKRRLTKFHSEIEELLYSDVENKEHLCVLKDKKKPILFTMARLDRVKNLSGLVEWYGKNTRLRELANLVVVGGDRRKESKDNEEKAEMKKMYDLIEEYKLNGQFRWISSQMDRVRNGELYRYICDTKGAFVQPALYEAFGLTVVEAMTCGLPTFATCKGGPAEIIVHGKSGFHIDPYHGDQAADTLADFFTKCKEDPSHWDEISKGGLQRIEEKYTWQIYSQRLLTLTGVYGFWKHVSNLDRLEARRYLEMFYALKYRPLAQAVPLAQDD

SEQ ID NO: 416 - DNA, 2487 bp, Artificial Sequence
  AtSus1 (gDNA, native)
atgaaacatcaccatcaccatcaccagctgcatgcgggagctcatgcggccgcgggtaccatggcaaacgctgaacgtatgataacgcgcgtccacagccaacgtgagcgtttgaacgaaacgcttgtttctgagagaaacgaagtccttgccttgctttccagggttgaagccaaaggtaaaggtattttacaacaaaaccagatcattgctgaattcgaagctttgcctgaacaaacccggaagaaacttgaaggtggtcctttctttgaccttctcaaatccactcaggaagcaattgtgttgccaccatgggttgctctagctgtgaggccaaggcctggtgtttgggaatacttacgagtcaatctccatgctcttgtcgttgaagaactccaacctgctgagtttcttcatttcaaggaagaactcgttgatggagttaagaatggtaatttcactcttgagcttgatttcgagccattcaatgcgtctatccctcgtccaacactccacaaatacattggaaatggtgttgacttccttaaccgtcatttatcggctaagctcttccatgacaaggagagtttgcttccattgcttaagttccttcgtcttcacagccaccagggcaagaacctgatgttgagcgagaagattcagaacctcaacactctgcaacacaccttgaggaaagcagaagagtatctagcagagcttaagtccgaaacactgtatgaagagtttgaggccaagtttgaggagattggtcttgagaggggatggggagacaatgcagagcgtgtccttgacatgatacgtcttcttttggaccttcttgaggcgcctgatccttgcactcttgagacttttcttggaagagtaccaatggtgttcaacgttgtgatcctctctccacatggttactttgctcaggacaatgttcttggttaccctgacactggtggacaggttgtttacattcttgatcaagttcgtgctctggagatagagatgcttcaacgtattaagcaacaaggactcaacattaaaccaaggattctcattctaactcgacttctacctgatgcggtaggaactacatgcggtgaacgtctcgagagagtttatgattctgagtactgtgatattcttcgtgtgcccttcagaacagagaagggtattgttcgcaaatggatctcaaggttcgaagtctggccatatctagagacttacaccgaggatgctgcggttgagctatcgaaagaattgaatggcaagcctgaccttatcattggtaactacagtgatggaaatcttgttgcttctttattggctcacaaacttggtgtcactcagtgtaccattgctcatgctcttgagaaaacaaagtacccggattctgatatctactggaagaagcttgacgacaagtaccatttctcatgccagttcactgcggatattttcgcaatgaaccacactgatttcatcatcactagtactttccaagaaattgctggaagcaaagaaactgttgggcagtatgaaagccacacagcctttactcttcccggattgtatcgagttgttcacgggattgatgtgtttgatcccaagttcaacattgtctctcctggtgctgatatgagcatctacttcccttacacagaggagaagcgtagattgactaagttccactctgagatcgaggagctcctctacagcgatgttgagaacaaagagcacttatgtgtgctcaaggacaagaagaagccgattctcttcacaatggctaggcttgatcgtgtcaagaacttgtcaggtcttgttgagtggtacgggaagaacacccgcttgcgtgagctagctaacttggttgttgttggaggagacaggaggaaagagtcaaaggacaatgaagagaaagcagagatgaagaaaatgtatgatctcattgaggaatacaagctaaacggtcagttcaggtggatctcctctcagatggaccgggtaaggaacggtgagctgtaccggtacatctgtgacaccaagggtgcttttgtccaacctgcattatatgaagcctttgggttaactgttgtggaggctatgacttgtggtttaccgactttcgccacttgcaaaggtggtccagctgagatcattgtgcacggtaaatcgggtttccacattgacccttaccatggtgatcaggctgctgatactcttgctgatttcttcaccaagtgtaaggaggatccatctcactgggatgagatctcaaaaggagggcttcagaggattgaggagaaatacacttggcaaatctattcacagaggctcttgacattgactggtgtgtatggattctggaagcatgtctcgaaccttgaccgtcttgaggctcgccgttaccttgaaatgttctatgcattgaagtatcgcccattggctcaggctgttcctcttgcacaagatgattga

SEQ ID NO: 417 - protein, 759 aa, Artificial Sequence; identical to SEQ ID NO: 70
  SgCbQ

SEQ ID NO: 418 - DNA, 2280 bp, Artificial Sequence; identical to SEQ ID NO: 320
  SgCbQ (gDNA)

SEQ ID NO: 419 - DNA, 2280 bp, Unknown; identical to SEQ ID NO: 320
  Siraitia grosvenorii cucurbitadienol synthase

SEQ ID NO: 420 - protein, 766 aa, Artificial Sequence; identical to SEQ ID NO: 321
  Cpep2

SEQ ID NO: 421 - DNA, 2301 bp, Artificial Sequence; identical to SEQ ID NO: 322
  Cpep2

SEQ ID NO: 422 - protein, 766 aa, Artificial Sequence; identical to SEQ ID NO: 323
  Cpep4

SEQ ID NO: 423 - DNA, 2301 bp, Artificial Sequence; identical to SEQ ID NO: 324
  Cpep4

SEQ ID NO: 424 - protein, 764 aa, Artificial Sequence; identical to SEQ ID NO: 325
  Cmax1

SEQ ID NO: 425 - DNA, 2295 bp, Artificial Sequence; identical to SEQ ID NO: 326
  Cmax1

SEQ ID NO: 426 - protein, 765 aa, Artificial Sequence; identical to SEQ ID NO: 327
  Cmos1

SEQ ID NO: 427 - DNA, 2296 bp, Artificial Sequence; identical to SEQ ID NO: 328
  Cmos1

SEQ ID NO: 428 - protein, 314 aa, Artificial Sequence; identical to SEQ ID NO: 313
  EPH

SEQ ID NO: 429 - DNA, 945 bp, Artificial Sequence
  EPH (codon optimized E coli)
atggagaagattgaacactctactatcgctactaatggtatcaatatgcacgttgcctctgctggttctggtccagctgttttgtttttgcacggtttcccagaattatggtattcctggagacaccaattgttgtacttgtcttctttgggttacagagctattgctccagatttgagaggtttcggtgacaccgatgctccaccatctccatcctcctacaccgcccaccacatcgttggtgatttggtcggtttgttggatcaattaggtgtcgatcaagtctttttggttggtcatgattggggtgctatgatggcctggtacttctgtttgttccgtccagacagagtcaaggccttagttaatttatctgtccacttcaccccacgtaacccagctatctctccattagatggtttccgtttgatgttgggtgatgatttctacgtttgtaagtttcaagaaccaggtgtcgctgaagccgatttcggttctgttgatactgccactatgtttaaaaagttcttgaccatgagagatccacgtccacctattattccaaacggtttcagatccttggccaccccagaagctttgccatcctggttgactgaagaggatatcgattactttgctgccaaattcgctaagactggttttactggtggtttcaactactacagagctatcgacttgacctgggagttgactgctccatggtccggttctgaaatcaaggttccaactaagtttattgttggtgacttagacttggtttaccatttcccaggtgttaaggaatacattcacggtggtggtttcaagaaggacgttccattcttggaagaagttgtcgtcatggaaggtgctgctcattttatcaaccaagaaaaagctgacgaaattaattctttgatctatgacttcattaaacaattctag

SEQ ID NO: 430 - protein, 473 aa, Artificial Sequence; identical to SEQ ID NO: 49
  CYP87D18

SEQ ID NO: 431 - DNA, 1422 bp, Artificial Sequence; identical to SEQ ID NO: 42
  CYP87D18

SEQ ID NO: 432 - protein, 688 aa, Artificial Sequence; identical to SEQ ID NO: 317
  AtCPR

SEQ ID NO: 433 - DNA, 2067 bp, Artificial Sequence; identical to SEQ ID NO: 318
  AtCPR

SEQ ID NO: 434 - protein, 767 aa, Artificial Sequence
  AGY15763.1
MWKVPKFIKQSYLVFLLALLLYSSFGFSFSRTEATTSTGALGPVTPKDTIYQIVTDRFFDGDPSNNKPPGFDPTLFDDPDGNNQGNGKDLKLYQGGDFQGIIDKIPYLKNMGITAVWISAPYENRDTVIEDYQSDGSINRWTSFHGYHARNYFATNKHFGTMKDFIRLRDALHQNGIKLVIDFVSNHSSRWQNPTLNFAPEDGKLYEPDKDANGNYVFDANGEPADYNGDGKVENLLADPHNDVNGFFHGLGDRGNDTSRFGYRYKDLGSLADYSQENALVVEHLEKAAKFWKSKGIDGFRHDATLHMNPAFVKGFKDAIDSDAGGPVTHFGEFFIGRPDPKYDEYRTFPERTGVNNLDFEYFRAATNAFGNFSETMSSFGDMMIKTSNDYIYENQTVTFLDNHDVTRFRYIQPNDKPYHAALAVLMTSRGIPNIYYGTEQYLMPSDSSDIAGRMFMQTSTNFDENTTAYKVIQKLSNLRKNNEAIAYGTTEILYSTNDVLVFKRQFYDKQVIVAVNRQPDQTFTIPELDTTLPVGTYSDVLGGLLYGSSMSVNNVNGQNKISSFTLSGGEVNVWSYNPSLGTLTPRIGDVISTMGRPGNTVYIYGTGLGGSVTVKFGSTVATVVSNSDQMIEAIVPNTNPGIQNITVTKGSVTSDPFRYEVLSGDQVQVIFHVNATTNWGENIYVVGNIPELGSWDPNQSSEAMLNPNYPEWFLPVSVPKGATFEFKFIKKDNNGNVIWESRSNRVFTAPNSSTGTIDTPLYFWDN

SEQ ID NO: 435 - protein, 733 aa, Artificial Sequence
  AGY15764.1
TTSTGALGPVTPKDTIYQIVTDRFFDGDPSNNKPPGFDPTLFDDPDGNNQGNGKDLKLYQGGDFQGIIDKIPYLKNMGITAVWISAPYENRDTVIEDYQSDGSINRWTSFHGYHARNYFATNKHFGTMKDFIRLRDALHQNGIKLVIDFVSNHSSRWQNPTLNFAPEDGKLYEPDKDANGNYVFDANGEPADYNGDGKVENLLADPHNDVNGFFHGLGDRGNDTSRFGYRYKDLGSLADYSQENALVVEHLEKAAKFWKSKGIDGFRHDATLHMNPAFVKGFKDAIDSDAGGPVTHFGEFFIGRPDPKYDEYRTFPERTGVNNLDFEYFRAATNAFGNFSETMSSFGDMMIKTSNDYIYENQTVTFLDNHDVTRFRYIQPNDKPYHAALAVLMTSRGIPNIYYGTEQYLMPSDSSDIAGRMFMQTSTNFDENTTAYKVIQKLSNLRKNNEAIAYGTTEILYSTNDVLVFKRQFYDKQVIVAVNRQPDQTFTIPELDTTLPVGTYSDVLGGLLYGSSMSVNNVNGQNKISSFTLSGGEVNVWSYNPSLGTLTPRIGDVISTMGRPGNTVYIYGTGLGGSVTVKFGSTVATVVSNSDQMIEAIVPNTNPGIQNITVTKGSVTSDPFRYEVLSGDQVQVIFHVNATTNWGENIYVVGNIPELGSWDPNQSSEAMLNPNYPEWFLPVSVPKGATFEFKFIKKDNNGNVIWESRSNRVFTAPNSSTGTIDTPLYFWDN

SEQ ID NO: 436 - protein, 473 aa, Artificial Sequence
  311
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKDAAALEHHHHHH

SEQ ID NO: 437 - DNA, 1389 bp, Artificial Sequence
  311(gDNA native)
atggactccggctactcctcctcctacgccgccgccgccgggatgcacgtcgtgatctgcccgtggctcgccttcggccacctgctcccgtgcctcgacctcgcccagcgcctcgcgtcgcggggccaccgcgtgtcgttcgtctccacgccgcggaacatatcccgcctcccgccggtgcgccccgcgctcgcgccgctcgtcgccttcgtggcgctgccgctcccgcgcgtcgaggggctccccgacggcgccgagtccaccaacgacgtcccccacgacaggccggacatggtcgagctccaccggagggccttcgacgggctcgccgcgcccttctcggagttcttgggcaccgcgtgcgccgactgggtcatcgtcgacgtcttccaccactgggccgcagccgccgctctcgagcacaaggtgccatgtgcaatgatgttgttgggctctgcacatatgatcgcttccatagcagacagacggctcgagcgcgcggagacagagtcgcctgcggctgccgggcagggacgcccagcggcggcgccaacgttcgaggtggcgaggatgaagttgatacgaaccaaaggctcatcgggaatgtccctcgccgagcgcttctccttgacgctctcgaggagcagcctcgtcgtcgggcggagctgcgtggagttcgagccggagaccgtcccgctcctgtcgacgctccgcggtaagcctattaccttccttggccttatgccgccgttgcatgaaggccgccgcgaggacggcgaggatgccaccgtccgctggctcgacgcgcagccggccaagtccgtcgtgtacgtcgcgctaggcagcgaggtgccactgggagtggagaaggtccacgagctcgcgctcgggctggagctcgccgggacgcgcttcctctgggctcttaggaagcccactggcgtctccgacgccgacctcctccccgccggcttcgaggagcgcacgcgcggccgcggcgtcgtggcgacgagatgggttcctcagatgagcatactggcgcacgccgccgtgggcgcgttcctgacccactgcggctggaactcgaccatcgaggggctcatgttcggccacccgcttatcatgctgccgatcttcggcgaccagggaccgaacgcgcggctaatcgaggcgaagaacgccggattgcaggtggcaagaaacgacggcgatggatcgttcgaccgagaaggcgtcgcggcggcgattcgtgcagtcgcggtggaggaagaaagcagcaaagtgtttcaagccaaagccaagaagctgcaggagatcgtcgcggacatggcctgccatgagaggtacatcgacggattcattcagcaattgagatcttacaaggattga

SEQ ID NO: 438 - DNA, 1386 bp, Artificial Sequence
  311(gDNA codon opt Ecoli)
atggatagcggttatagcagcagctatgcagcagcagccggtatgcatgttgttatttgtccgtggctggcatttggtcatctgctgccgtgtctggatctggcacagcgtctggcaagccgtggtcatcgtgttagctttgttagcacaccgcgtaatattagccgtctgcctccggttcgtccggcactggcaccgctggttgcatttgttgcactgccgctgcctcgtgttgaaggtctgccggatggtgcagaaagcaccaatgatgttccgcatgatcgtccggatatggttgaactgcatcgtcgtgcatttgatggtctggcagcaccgtttagcgaatttctgggcaccgcatgtgcagattgggttattgttgatgtttttcatcattgggcagccgcagcagcactggaacataaagttccgtgtgcaatgatgctgctgggtagcgcacatatgattgcaagcattgcagatcgtcgtctggaacgtgcagaaaccgaaagtcctgcggcagcaggtcagggtcgtcctgcagccgcaccgacctttgaagttgcacgtatgaaactgattcgtaccaaaggtagcagcggtatgagcctggcagaacgttttagtctgaccctgagccgtagcagcctggttgttggtcgtagctgtgttgaatttgaaccggaaaccgttccgctgctgagcaccctgcgtggtaaaccgattacctttctgggtctgatgcctccgctgcatgaaggtcgtcgcgaagatggtgaagatgcaaccgttcgttggctggatgcacagcctgcaaaaagcgttgtttatgttgccctgggtagtgaagttccgctgggtgttgaaaaagtgcatgaactggcactgggtttagaactggcaggcacccgttttctgtgggcactgcgtaaaccgaccggtgttagtgatgccgatctgcttccggcaggttttgaagaacgtacccgtggtcgtggtgttgttgcaacccgttgggttccgcagatgagcattctggcacatgcagcagtgggtgcatttctgacccattgtggttggaatagcaccattgaaggcctgatgtttggccatccgctgattatgctgccgatttttggtgatcagggtccgaatgcacgtctgattgaagcaaaaaatgcaggtctgcaggttgcccgtaatgatggtgatggtagctttgatcgtgaaggtgttgcagcagccattcgtgcagttgcagttgaagaagaaagcagcaaagtttttcaggccaaagccaaaaaactgcaagaaattgttgcagatatggcctgccatgaacgttatattgatggttttattcagcagctgcgtagctacaaagat

SEQ ID NO: 439 - protein, 458 aa, Artificial Sequence
  UGT76G1
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 440 - DNA, 1377 bp, Artificial Sequence
  UGT76G1 (DNA, native)
atggaaaataaaacggagaccaccgttcgccggcgccggagaataatattattcccggtaccatttcaaggccacattaacccaattcttcagctagccaatgtgttgtactctaaaggattcagtatcaccatctttcacaccaacttcaacaaacccaaaacatctaattaccctcacttcactttcagattcatcctcgacaacgacccacaagacgaacgcatttccaatctaccgactcatggtccgctcgctggtatgcggattccgattatcaacgaacacggagctgacgaattacgacgcgaactggaactgttgatgttagcttctgaagaagatgaagaggtatcgtgtttaatcacggatgctctttggtacttcgcgcaatctgttgctgacagtcttaacctccgacggcttgttttgatgacaagcagcttgtttaattttcatgcacatgtttcacttcctcagtttgatgagcttggttacctcgatcctgatgacaaaacccgtttggaagaacaagcgagtgggtttcctatgctaaaagtgaaagacatcaagtctgcgtattcgaactggcaaatactcaaagagatattagggaagatgataaaacaaacaaaagcatcttcaggagtcatctggaactcatttaaggaactcgaagagtctgagctcgaaactgttatccgtgagatcccggctccaagtttcttgataccactccccaagcatttgacagcctcttccagcagcttactagaccacgatcgaaccgtttttcaatggttagaccaacaaccgccaagttcggtactgtatgttagttttggtagtactagtgaagtggatgagaaagatttcttggaaatagctcgtgggttggttgatagcaagcagtcgtttttatgggtggttcgacctgggtttgtcaagggttcgacgtgggtcgaaccgttgccagatgggttcttgggtgaaagaggacgtattgtgaaatgggttccacagcaagaagtgctagctcatggagcaataggcgcattctggactcatagcggatggaactctacgttggaaagcgtttgtgaaggtgttcctatgattttctcggattttgggctcgatcaaccgttgaatgctagatacatgagtgatgttttgaaggtaggggtgtatttggaaaatgggtgggaaagaggagagatagcaaatgcaataagaagagttatggtggatgaagaaggagaatacattagacagaatgcaagagttttgaaacaaaaggcagatgtttctttgatgaagggtggttcgtcttacgaatcattagagtctctagtttcttacatttcatcgttgtaa

SEQ ID NO: 441 - protein, 724 aa, Artificial Sequence
  UGT73C5
MSPILGYWKIKGLVQPTRLLLEYLEEKYEEHLYERDEGDKWRNKKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKSDLVPRGSVSETTKSSPLHFVLFPFMAQGHMIPMVDIARLLAQRGVIITIVTTPHNAARFKNVLNRAIESGLPINLVQVKFPYLEAGLQEGQENIDSLDTMERMIPFFKAVNFLEEPVQKLIEEMNPRPSCLISDFCLPYTSKIAKKFNIPKILFHGMGCFCLLCMHVLRKNREILDNLKSDKELFTVPDFPDRVEFTRTQVPVETYVPAGDWKDIFDGMVEANETSYGVIVNSFQELEPAYAKDYKEVRSGKAWTIGPVSLCNKVGADKAERGNKSDIDQDECLKWLDSKKHGSVLYVCLGSICNLPLSQLKELGLGLEESQRPFIWVIRGWEKYKELVEWFSESGFEDRIQDRGLLIKGWSPQMLILSHPSVGGFLTHCGWNSTLEGITAGLPLLTWPLFADQFCNEKLVVEVLKAGVRSGVEQPMKWGEEEKIGVLVDKEGVKKAVEELMGESDDAKERRRRAKELGDSAHKAVEEGGSSHSNISFLLQDIMELAEPNNAAAS

SEQ ID NO: 442 - DNA, 2175 bp, Artificial Sequence
  UGT73C5 (DNA, native)
atgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcgaagatcgtttatgtcataaaacatatttaaatggtgatcatgtaacccatcctgacttcatgttgtatgacgctcttgatgttgttttatacatggacccaatgtgcctggatgcgttcccaaaattagtttgttttaaaaaacgtattgaagctatcccacaaattgataagtacttgaaatccagcaagtatatagcatggcctttgcagggctggcaagccacgtttggtggtggcgaccatcctccaaaatcggatctggttccgcgtggatccgtttccgaaacaaccaaatcttctccacttcactttgttctcttccctttcatggctcaaggccacatgattcccatggttgatattgcaaggctcttggctcagcgtggtgtgatcataacaattgtcacgacgcctcacaatgcagcgaggttcaagaatgtcctaaaccgtgccattgagtctggcttgcccatcaacttagtgcaagtcaagtttccatatctagaagctggtttgcaagaaggacaagagaatatcgattctcttgacacaatggagcggatgatacctttctttaaagcggttaactttctcgaagaaccagtccagaagctcattgaagagatgaaccctcgaccaagctgtctaatttctgatttttgtttgccttatacaagcaaaatcgccaagaagttcaatatcccaaagatcctcttccatggcatgggttgcttttgtcttctgtgtatgcatgttttacgcaagaaccgtgagatcttggacaatttaaagtcagataaggagcttttcactgttcctgattttcctgatagagttgaattcacaagaacgcaagttccggtagaaacatatgttccagctggagactggaaagatatctttgatggtatggtagaagcgaatgagacatcttatggtgtgatcgtcaactcatttcaagagctcgagcctgcttatgccaaagactacaaggaggtaaggtccggtaaagcatggaccattggacccgtttccttgtgcaacaaggtaggagccgacaaagcagagaggggaaacaaatcagacattgatcaagatgagtgccttaaatggctcgattctaagaaacatggctcggtgctttacgtttgtcttggaagtatctgtaatcttcctttgtctcaactcaaggagctgggactaggcctagaggaatcccaaagacctttcatttgggtcataagaggttgggagaagtacaaagagttagttgagtggttctcggaaagcggctttgaagatagaatccaagatagaggacttctcatcaaaggatggtcccctcaaatgcttatcctttcacatccatcagttggagggttcctaacacactgtggttggaactcgactcttgaggggataactgctggtctaccgctacttacatggccgctattcgcagaccaattctgcaatgagaaattggtcgttgaggtactaaaagccggtgtaagatccggggttgaacagcctatgaaatggggagaagaggagaaaataggagtgttggtggataaagaaggagtgaagaaggcagtggaagaattaatgggtgagagtgatgatgcaaaagagagaagaagaagagccaaagagcttggagattcagctcacaaggctgtggaagaaggaggctcttctcattctaacatctctttcttgctacaagacataatggaactggcagaacccaataatgcggccgcatcgtga

SEQ ID NO: 443 - DNA, 1512 bp, Artificial Sequence
  UGT73C5 (Codon optimized Ecoli)
atgaggcatggatccgttagcgaaaccaccaaaagcagtccgctgcattttgttctgtttccgtttatggcacagggtcatatgattccgatggttgatattgcacgtctgctggcacagcgtggtgtgattattaccattgttaccacaccgcataatgcagcacgctttaaaaacgttctgaatcgtgcaattgaaagcggtctgccgattaatctggttcaggttaaatttccgtatctggaagcaggtctgcaagaaggtcaagaaaatattgatagcctggataccatggaacgcatgattccgtttttcaaagccgtgaattttctggaagaaccggtgcagaaactgatcgaagaaatgaatccgcgtccgagctgtctgattagcgatttttgtctgccgtataccagcaaaatcgccaaaaaattcaacatcccgaaaatcctgtttcatggtatgggttgtttttgcctgctgtgtatgcatgttctgcgtaaaaatcgtgaaatcctggataacctgaaaagcgataaagaactgtttaccgttccggattttccggatcgtgtggaatttacccgtacacaggttccggttgaaacctatgttccggcaggcgattggaaagatatttttgatggtatggtggaagccaacgaaaccagctatggtgttattgtgaatagctttcaagaactggaaccggcatatgcgaaagattacaaagaagttcgtagcggtaaagcatggaccattggtccggttagcctgtgtaataaagttggtgcagataaagcagaacgcggtaataaaagtgatatcgatcaggatgaatgcctgaaatggctggatagcaaaaaacatggtagcgttctgtatgtttgtctgggtagcatttgcaatctgccgctgagccagctgaaagaattaggtctgggtttagaagaaagccagcgtccgtttatttgggttattcgtggttgggagaaatacaaagaactggttgaatggtttagcgaaagcggttttgaagatcgtattcaggatcgtggcctgctgattaaaggttggagtccgcagatgctgattctgagccatccgagcgttggtggctttctgacccattgtggttggaatagcaccctggaaggtattacagctggcctgccgctgctgacctggcctctgtttgcagatcagttttgtaatgaaaaactggtggtggaagttctgaaagccggtgtgcgtagcggtgttgaacagccgatgaaatggggtgaagaagaaaaaattggcgtcctggttgataaagaaggtgttaaaaaagccgtggaagaactgatgggtgaaagtgatgatgcaaaagaacgtcgtcgtcgtgcaaaagagctgggcgatagcgcacataaagcagttgaagaaggtggtagcagccatagcaatattagctttctgctgcaggatattatggaactggcagaaccgaataactaagcggccgctgaa

SEQ ID NO: 444 - protein, 495 aa, Artificial Sequence; identical to SEQ ID NO: 5
  UGT73C6

SEQ ID NO: 445 - DNA, 1485 bp, Artificial Sequence
  UGT73C6 (gDNA, native)
atggctttcgaaaaaaacaacgaaccttttcctcttcactttgttctcttccctttcatggctcaaggccacatgattcccatggttgatattgcaaggctcttggctcagcgaggtgtgcttataacaattgtcacgacgcctcacaatgcagcaaggttcaagaatgtcctaaaccgtgccattgagtctggtttgcccatcaacctagtgcaagtcaagtttccatatcaagaagctggtctgcaagaaggacaagaaaatatggatttgcttaccacgatggagcagataacatctttctttaaagcggttaacttactcaaagaaccagtccagaaccttattgaagagatgagcccgcgaccaagctgtctaatctctgatatgtgtttgtcgtatacaagcgaaatcgccaagaagttcaaaataccaaagatcctcttccatggcatgggttgcttttgtcttctgtgtgttaacgttctgcgcaagaaccgtgagatcttggacaatttaaagtctgataaggagtacttcattgttccttattttcctgatagagttgaattcacaagacctcaagttccggtggaaacatatgttcctgcaggctggaaagagatcttggaggatatggtagaagcggataagacatcttatggtgttatagtcaactcatttcaagagctcgaacctgcgtatgccaaagacttcaaggaggcaaggtctggtaaagcatggaccattggacctgtttccttgtgcaacaaggtaggagtagacaaagcagagaggggaaacaaatcagatattgatcaagatgagtgccttgaatggctcgattctaaggaaccgggatctgtgctctacgtttgccttggaagtatttgtaatcttcctctgtctcagctccttgagctgggactaggcctagaggaatcccaaagacctttcatctgggtcataagaggttgggagaaatacaaagagttagttgagtggttctcggaaagcggctttgaagatagaatccaagatagaggacttctcatcaaaggatggtcccctcaaatgcttatcctttcacatccttctgttggagggttcttaacgcactgcggatggaactcgactcttgaggggataactgctggtctaccaatgcttacatggccactatttgcagaccaattctgcaacgagaaactggtcgtacaaatactaaaagtcggtgtaagtgccgaggttaaagaggtcatgaaatggggagaagaagagaagataggagtgttggtggataaagaaggagtgaagaaggcagtggaagaactaatgggtgagagtgatgatgcaaaagagagaagaagaagagccaaagagcttggagaatcagctcacaaggctgtggaagaaggaggctcctctcattctaatatcactttcttgctacaagacataatgcaactagcacagtccaataat

SEQ ID NO: 446 - protein, 759 aa, Artificial Sequence; identical to SEQ ID NO: 70
  SgCbQ

SEQ ID NO: 447 - protein, 418 aa, Artificial Sequence
  glycoside hydrolase family 5 [Trichoderma reesei QM6a] GenBank: EGR512.1
MNKSVAPLLLAASILYGGAAAQQTVWGQCGGIGWSGPTNCAPGSACSTLNPYYAQCIPGATTITTSTRPPSGPTTTTRATSTSSSTPPTSSGVRFAGVNIAGFDFGCTTDGTCVTSKVYPPLKNFTGSNNYPDGIGQMQHFVNDDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTGSGNSWTDTSLVSSCLARK

SEQ ID NO: 448 - protein, 249 aa, Artificial Sequence
  glycoside hydrolase family 61 [Trichoderma reesei QM6a] 249 aa protein EGR50392.1 GI:340520155
MKSCAILAALGCLAGSVLGHGQVQNFTINGQYNQGFILDYYYQKQNTGHFPNVAGWYAEDLDLGFISPDQYTTPDIVCHKNAAPGAISATAAAGSNIVFQWGPGVWPHPYGPIVTYVAECSGSCTTVNKNNLRWVKIQEAGINYNTQVWAQQDLINQGNKWTVKIPSSLRPGNYVFRHELLAAHGASSANGMQNYPQCVNIAVTGSGTKALPAGTPATQLYKPTDPGILFNPYTTITSYTIPGPALWQG

SEQ ID NO: 449 - protein, 326 aa, Artificial Sequence
  glycoside hydrolase family 61, partial [Trichoderma reesei QM6a] 326 aa protein EGR49821.1 GI:340519583
SAHTTFTTLFIDKKNQGDGTCVRMPYDDKTATNPVKPITSSDMACGRNGGDPVPFICSAKKGSLLTFEFRLWPDAQQPGSIDPGHLGPCAVYLKKVDNMFSDSAAGGGWFKIWEDGYDSKTQKWCVDRLVKNNGLLSVRLPRGLPAGYYIVRPEILALHWAAHRDDPQFYLGCAQIFVDSDVRGPLEIPRRQQATIPGYVNAKTPGLTFDIYQDKLPPYPMPGPKVYIPPAKGNKPNQDLNAGRLVQTDGLIPKDCLIKKANWCGRPVEPYSSARMCWRAVNDCYAQSKKCRESSPPIGLTNCDRWSDHCGKMDALCEQEKYKGPP

SEQ ID NO: 450 - protein, 459 aa, Artificial Sequence
  glycoside hydrolase family 7 [Trichoderma reesei QM6a] 459 aa protein EGR48251.1 GI:340518009
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVSITRKYQQNGVDIPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQCL

SEQ ID NO: 451 - protein, 242 aa, Artificial Sequence
  glycoside hydrolase family 45 [Trichoderma reesei QM6a] 242 aa protein EGR47058.1 GI:340516811
MKATLVLGSLIVGAVSAYKATTTRYYDGQEGACGCGSSSGAFPWQLGIGNGVYTAAGSQALFDTAGASWCGAGCGKCYQLTSTGQAPCSSCGTGGAAGQSIIVMVTNLCPNNGNAQWCPVVGGTNQYGYSYHFDIMAQNEIFGDNVVVDFEPIACPGQAASDWGTCLCVGQQETDPTPVLGNDTGSTPPGSSPPATSSSPPSGGGQQTLYGQCGGAGWTGPTTCQAPGTCKVQNQWYSQCLP

SEQ ID NO: 452 - protein, 438 aa, Artificial Sequence
  glycoside hydrolase family 5 [Trichoderma reesei QM6a] 438 aa protein EGR44174.1 GI:340513898
MRATSLLAAALAVAGDALAGKIKYLGVAIPGIDFGCDIDGSCPTDTSSVPLLSYKGGDGAGQMKHFAEDDGLNVFRISATWQFVLNNTVDGKLDELNWGSYNKVVNACLETGAYCMIDMHNFARYNGGIIGQGGVSDDIFVDLWVQIAKYYEDNDKIIFGLMNEPHDLDIEIWAQTCQKVVTAIRKAGATSQMILLPGTNFASVETYVSTGSAEALGKITNPDGSTDLLYFDVHKYLDINNSGSHAECTTDNVDAFNDFADWLRQNKRQAIISETGASMEPSCMTAFCAQNKAISENSDVYIGFVGWGAGSFDTSYILTLTPLGKPGNYTDNKLMNECILDQFTLDEKYRPTPTSISTAAEETATATATSDGDAPSTTKPIFREETASPTPNAVTKPSPDTSDSSDDDKDSAASMSAQGLTGTVLFTVAALGYMLVAF

SEQ ID NO: 453 - protein, 242 aa, Artificial Sequence; identical to SEQ ID NO: 451
  glycoside hydrolase family 45 [Trichoderma reesei QM6a] 242 aa protein XP_006967072.1 GI:589110099

SEQ ID NO: 454 - protein, 459 aa, Artificial Sequence; identical to SEQ ID NO: 450
  glycoside hydrolase family 7 [Trichoderma reesei QM6a] 459 aa protein XP_006965674.1 GI:589107303

SEQ ID NO: 455 - protein, 459 aa, Artificial Sequence; identical to SEQ ID NO: 450
  glycoside hydrolase family 61, partial [Trichoderma reesei QM6a] 326 aa protein XP_006964038.1 GI:589104031

SEQ ID NO: 456 - protein, 326 aa, Artificial Sequence; identical to SEQ ID NO: 449
  glycoside hydrolase family 61, partial [Trichoderma reesei QM6a] 326 aa protein XP_006964038.1 GI:589104031

SEQ ID NO: 457 - protein, 249 aa, Artificial Sequence; identical to SEQ ID NO: 448
  glycoside hydrolase family 61 [Trichoderma reesei QM6a] 249 aa protein XP_006963879.1 GI:589103713

SEQ ID NO: 458 - protein, 418 aa, Artificial Sequence; identical to SEQ ID NO: 447
  glycoside hydrolase family 5 [Trichoderma reesei QM6a] 418 aa protein XP_006962583.1 GI:589101121

SEQ ID NO: 459 - protein, 344 aa, Artificial Sequence
  glycoside hydrolase family 61 [Trichoderma reesei QM6a] 344 aa protein  XP_006961567.1 GI:589099089
MIQKLSNLLVTALAVATGVVGHGHINDIVINGVWYQAYDPTTFPYESNPPIVVGWTAADLDNGFVSPDAYQNPDIICHKNATNAKGHASVKAGDTILFQWVPVPWPHPGPIVDYLANCNGDCETVDKTTLEFFKIDGVGLLSGGDPGTWASDVLISNNNTWVVKIPDNLAPGNYVLRHEIIALHSAGQANGAQNYPQCFNIAVSGSGSLQPSGVLGTDLYHATDPGVLINIYTSPLNYIIPGPTVVSGLPTSVAQGSSAATATASATVPGGGSGPTSRTTTTARTTQASSRPSSTPPATTSAPAGGPTQTLYGQCGGSGYSGPTRCAPPATCSTLNPYYAQCLN

SEQ ID NO: 460 - protein, 249 aa, Artificial Sequence
  Endoglucanase 249 aa protein Q7Z9M7.3 GI:43314396
MKSCAILAALGCLAGSVLGHGQVQNFTINGQYNQGFILDYYYQKQNTGHFPNVAGWYAEDLDLGFISPDQYTTPDIVCHKNAAPGAISATAAAGSNIVFQWGPGVWPHPYGPIVTYVVECSGSCTTVNKNNLRWVKIQEAGINYNTQVWAQQDLINQGNKWTVKIPSSLRPGNYVFRHELLAAHGASSANGMQNYPQCVNIAVTGSGTKALPAGTPATQLYKPTDPGILFNPYTTITSYTIPGPALWQG

SEQ ID NO: 461 - protein, 222 aa, Artificial Sequence
  xylanase [Trichoderma reesei] 222 aa protein CAA49293.1 GI:396564
MVSFTSLLAASPPSRASCRPAAEVESVAVEKRQTIQPGTGYNNGYFYSYWNDGHGGVTYTNGPGGQFSVNWSNSGNFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 462 - protein, 229 aa, Artificial Sequence
  xylanase [Trichoderma reesei] 229 aa protein CAA49294.1 GI:396566
MVAFSSLICALTSIASTLAMPTGLEPESSVNVTERGMYDFVLGAHNDHRRRASINYDQNYQTGGQVSYSPSNTGFSVNWNTQDDFVVGVGWTTGSSAPINFGGSFSVNSGTGLLSVYGWSTNPLVEYYIMEDNHNYPAQGTVKGTVTSDGATYTIWENTRVNEPSIQGTATFNQYISVRNSPRTSGTVTVQNHFNAWASLGLHLGQMNYQVVAVEGWGGSGSASQSVSN

SEQ ID NO: 463 - protein, 223 aa, Artificial Sequence
  beta-xylanase precursor [Trichoderma reesei] 223 aa protein AAB5278.1 GI:78816
MVSFTSLLAGVAAISGVLAAPAAEVEPVAVEKRQTIQPGTGYNNGYFHSYWNDGHGGVTYTNGPGGQFSVNWSNSGNFVGGKGWQPGTKNKVINFSGSYNPNGNSYLSVYGWSRNPLIEYYIVGNFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 464 - protein, 190 aa, Artificial Sequence
  Chain A, Structural Comparison Of Two Major Endo-1,4-Beta-Xylanases From Trichodrema Reesei 19 aa protein 1XYP_A GI:112721
  VARIANT 1: Xaa = Any Amino Acid
XTIQPGTGYNNGYFYSYWNDGHGGVTYTNGPGGQFSVNWSNSGNFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 465 - protein, 190 aa, Artificial Sequence; identical to SEQ ID NO: 464
  Chain B, Structural Comparison Of Two Major Endo-1,4-Beta-Xylanases From Trichodrema Reesei 19 aa protein 1XYP_B GI:1127211
  VARIANT 1: Xaa = Any Amino Acid

SEQ ID NO: 466 - protein, 190 aa, Artificial Sequence; identical to SEQ ID NO: 464
  Chain A, Structural Comparison Of Two Major Endo-1,4-Beta-Xylanases From Trichodrema Reesei 19 aa protein 1XYO_A GI:1127212
  VARIANT 1: Xaa = Any Amino Acid

SEQ ID NO: 467 - protein, 190 aa, Artificial Sequence; identical to SEQ ID NO: 464
  Chain B, Structural Comparison Of Two Major Endo-1,4-Beta-Xylanases From Trichodrema Reesei 19 aa protein 1XYO_B GI:1127213
  VARIANT 1: Xaa = Any Amino Acid

SEQ ID NO: 468 - protein, 190 aa, Artificial Sequence; identical to SEQ ID NO: 464
  Chain A, Structural Comparison Of Two Major Endo-1,4-Beta-Xylanases From Trichodrema Reesei 19 aa protein 1ENX_A GI:1127272
  VARIANT 1: Xaa = Any Amino Acid

SEQ ID NO: 469 - protein, 190 aa, Artificial Sequence; identical to SEQ ID NO: 464
  Chain B, Structural Comparison Of Two Major Endo-1,4-Beta-Xylanases From Trichodrema Reesei 19 aa protein 1ENX_B GI:1127273
  VARIANT 1: Xaa = Any Amino Acid

SEQ ID NO: 470 - protein, 190 aa, Artificial Sequence; identical to SEQ ID NO: 464
  Chain A, Endo-1,4-beta-xylanase Ii Complex With 4,5-epoxypentyl-beta- D-xyloside 190 aa protein 1RED_A GI:1942592
  VARIANT 1: Xaa = Any Amino Acid

SEQ ID NO: 471 - protein, 190 aa, Artificial Sequence; identical to SEQ ID NO: 464
  ChainB, Endo-1,4-beta-xylanase Ii Complex With 4,5-epoxypentyl-beta- D-xyloside 190 aa protein 1RED_B GI:1942593
  VARIANT 1: Xaa = Any Amino Acid

SEQ ID NO: 472 - protein, 190 aa, Artificial Sequence; identical to SEQ ID NO: 464
  Chain A, Endo-1,4-Beta-Xylanase Ii Complex With 3,4-Epoxybutyl-Beta- D-Xyloside 190 aa protein 1REE_A GI:1942594
  VARIANT 1: Xaa = Any Amino Acid

SEQ ID NO: 473 - protein, 190 aa, Artificial Sequence; identical to SEQ ID NO: 464
  Chain B, Endo-1,4-Beta-Xylanase Ii Complex With 3,4-Epoxybutyl-Beta- D-Xyloside190 aa protein 1REE_B GI:1942595
  VARIANT 1: Xaa = Any Amino Acid

SEQ ID NO: 474 - protein, 190 aa, Artificial Sequence; identical to SEQ ID NO: 464
  Chain A, Endo-1,4-Beta-Xylanase Ii Complex With 2,3-Epoxypropyl-Beta- D-Xyloside 190 aa protein 1REF_A GI:1942596
  VARIANT 1: Xaa = Any Amino Acid

SEQ ID NO: 475 - protein, 190 aa, Artificial Sequence; identical to SEQ ID NO: 464
  Chain B, Endo-1,4-Beta-Xylanase Ii Complex With 2,3-Epoxypropyl-Beta-D-Xyloside 1REF_B GI:1942597 xylanase III [Trichoderma reesei] 347 aa protein BAA89465.2 GI:7328936
  VARIANT 1: Xaa = Any Amino Acid

SEQ ID NO: 476 - protein, 71 aa, Artificial Sequence
  xylanase, partial [Trichoderma reesei] 71 aa protein AAG01167.1 GI:9858850
  VARIANT 9: Xaa = Any Amino Acid
SYLSVYGWXTDPLIEYYIVESYGDYNPGSGGTYKGTVTSDGSVYDIYTATRTNAASIQGTATFTQYWSVRR

SEQ ID NO: 477 - protein, 341 aa, Artificial Sequence
  transcription factor ACEII [Trichoderma reesei] 341 aa protein AAK69383.1 GI:14581734
MDLRQACDRCHDKKLRCPRISGSPCCSRCAKANVACVFSPPSRPFRPHEPLNHSHEHSHSHSHNHNGVGVSFDWLDLMSLEQQQEQQQGQPQHPPPPVQTLSERLAALLCALDRMLQAVPSSLDMHHVSRQQLREYADTVGTGFDLQSTLDSLLHHAQDLASLYSEAVPASFNKRTTAAEADALCAVPDCVHQDRTSLHTTPLPKLDHALLNLVMACHIRLLDVMDTLAEHGRMCAFMVATLPPDYDPKFAVPEIRVGTFVAPTDTAASMLLSVVVELQTVLVARVKDLVAMVDQVKDDARAAREAKVVRLQCGILLERAESTLGEWSRFKDGLVSARLLK

SEQ ID NO: 478 - protein, 934 aa, Artificial Sequence
  xylanase regulator 1, partial [Trichoderma reesei] 934 aa protein AAO33577.1 GI:28194501
MLSNPLRRYSAYPDISSASFDPNYHGSQSHLHSINVNTFGNSHPYPMQHLAQHAELSSSRMIRASPVQPKQRQGSLIAARKNSTGTAGPIRRRISRACDQCNQLRTKCDGLHPCAHCIEFGLGCEYVRERKKRGKASRKDIAAQQAAAAAAQHSGQVQDGPEDQHRKLSRQQSESSRGSAELAQPAHDPPHGHIEGSVSSFSDNGLSQHAAMGGMDGLEDHHGHVGVDPALGRTQLEASSAMGLGAYGEVHPGYESPGMNGHVMVPPSYGAQTTMAGYSGISYAAQAPSPATYSSDGNFRLTGHIHDYPLANGSSPSWGVSLASPSLRYHVLRPVLLDVRNIYPVSLACDQMDMYFSSSSSAQMRPMSPYVEGFVFRKRSFLHPTDPRRCQPALLASMLWVAAQTSEASFLTSLPSARSKVCQKLLELTVGLLQPLIHTGTNSPSPKTSPVVGAAALGVLGVAMPGSLNMDSLAGETGAFGAIGSLDDVIAYVRLATVVSASEYKGASLRWWGAAWSLARELKLGRELPPGNPPANQEDGEGLSEDVDEHDLNRNNTRLGRKRSAKSDAITEEEREERRRAWWLVYIVDRHLALCYNRPLFLLDSECSDLYHPMDDIKWQAGKFRSHDAGNSSINIDSSMTDEFGDSPRAARGAHYECRGRSIFGYFLSLMTILGEIVDVHHAKSHPRFGVGFRSARDWDEQVAEITRHLDMYEESLKRFVAKHLPLSSKDKEQHEMHDSGAVTDMQSPLSVRTNASSRMTESEIQASIVVAYSTHVMHVLHILLADKWDPINLLDDDDLWISSEGFVTATSHAVSAAEAISQILEFDPGLEFMPFFFGIYLLQGSFLLLLIADKLQAEASPSVIKACETIVRAHEACVVTLSTEYQRNFSKVMRSALALIRGRVPEDLAEQQQRRRELLALYRWTGNGTGLAL

SEQ ID NO: 479 - protein, 341 aa, Artificial Sequence; identical to SEQ ID NO: 477
  RecName: Full=Transcription factor ACEII 341 aa protein Q96WN6.1 GI:50400614

SEQ ID NO: 480 - protein, 189 aa, Artificial Sequence
  Chain A, Structure Of Vil-Xylanase 189 aa protein 2D97_A GI:112490431
  VARIANT 8, 72, 134, 178: Xaa = Any Amino Acid
TIQPGTGXNNGYFYSYWNDGHGGVTYTNGPGGQFSVNWSNSGNFVGGKGWQPGTKNKVINFSGSYNPNGNSXLSVYGWSRNPLIEYYIVENFGTYNPSTGATKLGEVTSDGSVYDIYRTQRVNQPSIIGTATFXQYWSVRRNHRSSGSVNTANHFNAWAQQGLTLGTMDYQIVAVEGXFSSGSASITVS

SEQ ID NO: 481 - protein, 189 aa, Artificial Sequence
  Chain A, Structure Of Vil (Extra KiI2 ADDED)-Xylanase 189 aa protein 2D98_A GI:112490433
  VARIANT 8, 72, 95, 134, 170, 178: Xaa = Any Amino Acid
TIQPGTGXNNGYFYSYWNDGHGGVTYTNGPGGQFSVNWSNSGNFVGGKGWQPGTKNKVINFSGSYNPNGNSXLSVYGWSRNPLIEYYIVENFGTXNPSTGATKLGEVTSDGSVYDIYRTQRVNQPSIIGTATFXQYWSVRRNHRSSGSVNTANHFNAWAQQGLTLGTMDXQIVAVEGXFSSGSASITVS

SEQ ID NO: 482 - protein, 190 aa, Artificial Sequence; identical to SEQ ID NO: 464
  Chain A, Xylanase Ii From Tricoderma Reesei At 100k 190 aa protein 2DFB_A GI:112490475
  VARIANT 1: Xaa = Any Amino Acid

SEQ ID NO: 483 - protein, 190 aa, Artificial Sequence; identical to SEQ ID NO: 464
  Chain A, Xylanase Ii From Tricoderma Reesei At 293k 190 aa protein 2DFC_A GI:112490477
  VARIANT 1: Xaa = Any Amino Acid

SEQ ID NO: 484 - protein, 324 aa, Artificial Sequence
  TPA_inf: chitinase 18-12 [Trichoderma reesei] 324 aa protein DAA05860.1 GI:126032263
MPSLTALAGLLALVPSALAGWNPDSKQNIAVYWGQNSANSQSTQQRLSFYCNDDNINVIEIAFLNGINPPMTNFANAGDRCTPFSDNPWLLSCPEIEADIKTCQANGKTILLSLGGDTYSQGGWASPEAAQDAAAQVWAMFGPVQSDSSAPRPFGDAVVDGFDFDFESTTNNLVAFGAQLRTLSDAAATDSNKKFYLAAAPQCFFPDAAVGPLINAVPMDWIQIQFYNNPCGVSAYTPGSEQQNNYNYQTWEDWAKTSPNPNVKLLVGIPAGPNAGHGYVSDAQLKSVFEYSKKFDTFAGAMMWDMSQLYQNSGFEDQVVDALK

SEQ ID NO: 485 - protein, 324 aa, Artificial Sequence; identical to SEQ ID NO: 484
  TPA_inf: chitinase 18-12 [Trichoderma reesei] 324 aa protein DAA05860.1 GI:126032263

SEQ ID NO: 486 - protein, 401 aa, Artificial Sequence
  TPA_inf: chitinase 18-13 [Trichoderma reesei] 401 aa protein DAA5861.1 GI:126032265
MFFSKALAAAGLLATAAYAAPTMEKRAAGGKLVVYWGAEDDSTTLANVCADSSYDIVNLAFLSRFFAGGGYPELSLSTLGGPSAAQRAAGATNLQDGTSLIPAIQACQAAGKLVILSMGGAVDFSAVTLSSDAQGQQLADTVWNLFLGGTANPTLRPFGSVKLDGVDLDNETGNPTGYLAMAQRFKSNFAKDTSKKYYLTAAPQCPFPDASEPLNVCQLADYIWVQFYNNGNCNIAQSGFNNAVKNWSKSIGNATLFIGALASGADGDQGYVSASSLLSAYQGVSALNLPNIGGIMLWEAQLAVKNGNFQKTVKAGIASGTTPPPPPPTGGCSWAGHCAGASCSTDNDCSDDLTCNGGVCGTAGSTPAPTCSWEGHCLGASCGNDNDCSDPYSCKNGVCSN

SEQ ID NO: 487 - protein, 411 aa, Artificial Sequence
  TPA_inf: chitinase 18-14 [Trichoderma reesei] 411 aa protein DAA05862.1 GI:126032267
MFFTKAVGGLGLLASLASSAPNPIARRQAPGAQNVVYWGQNGGGTVENNDLSAYCTPTSGIDIIVLSFLYQWGQGSSALGGTIGQSCGITTSGEPQNCDALTAAITKCKTAGVKIILSLGGASAFSSFQTADQAAQAGQYLWNAYGGGSGVTRPLGNNVMDGFDLDIESNPGTNENYAALVSALRSNFASDPSRQYVISGAPQCPLPEPNMGVIIQNAQFDYLWVQFYNNNEYPGDPCSLGLPGDAPFNFNNWTTFIQSTPSKDAKVFVGVPAAPLAANGAPSGEVYYATPSQLADIVNDVKSNPAFGGIMMWSAGFSDTNVNDGCNYAQEAKNILLTGSPCSSGPVSVSRPPVSSPTITSSPPGTSPAPPSQTGSVPQWGQCGGNGYTGPTQCVAPFKCVATSEWWSQCE

SEQ ID NO: 488 - protein, 401 aa, Artificial Sequence
  TPA_inf: chitinase 18-16 [Trichoderma reesei] 401 aa protein DAA05864.1 GI:126032269
MLSRTLLTALGLTTIAAAAPSQTVKTRQAPGGQNAVYWGATNNENDNLSTYCTASSGIDIVILSFLDIYGATGNFPSGNMGNSCYVGTNGVPQLCDDLASSIATCQAAGIKVIISLGGAASSYSLQSQSQAVAIGQYLWNAYGNSGNTTVQRPFGNVFVNGFDFDIELNAGSQYYQYLISTLRSNFANDPKNTYYITGAPQCPIPEPNMGEIISTSQFDYLWVQFYNNNPVCSLGLPGDAPFNFNDWVSFISTTPSKNAKLFVGAPASTLGANGNAGGAKYYATPEQLAGIVNSVKSSPFFGGIMLWDAGYSDSNVNNGCNYAQEAKNILLTGTACGGESSPPPSTTTTAVPPPASSTPSNPSGGSVPQWGQCGGDGYTGPTQCVAPYKCVATSEWWSSCQ

SEQ ID NO: 489 - protein, 1034 aa, Artificial Sequence
  TPA_inf: chitinase 18-18 [Trichoderma reesei] 1034 aa protein DAA05866.1 GI:126032275
MVSASAGLAAVGLLNGYWGQYTTTEGLRPHCDSGVDSITLGFVNGAPDASGYPSLNFGPNCWAESYPGNLGLPSKLLSHCMSLQSDIPYCRSKGVKVILSIGGVYNALTSNYFVGDNGTATDFATFLYNAFGPYNASYTGPRPFDDITTGLPTSVDGFDFDIEADFPNGPYIKMIETFRSLDSSMLITGAPQCPTNPQYFVMKDMIQQAAFDKLFIQFYNNPVCDAIPGNTAGDKFNYDDWEAVIAGSAKSKSAKLYIGLPAIQEPNESGYIDPIAMKNLVCQYKDRPHFGGLSLWDLSRGLVNNINGTSFNQWALDALQYGCNPIPTTTTTTSTVSSTTAASSTTASSTTASTTKASSTSKASSTSKASSTSKASSTSKASSTSKASSTSKASSTSKASTTSKASTTSKVSTTSKASSTSKASSSTKASTTSKASSTSKASTTSKASTTSKASTTSKASTTSKASTTSKASSTSKASSSTKASTTSKASSTSKASTTSKASTTSKASTTSKASTTSKASTTSKASSTSKASSSTKASTTSKASSTSKASTTSKASTTSKASTTSKASTTSKASTTSKASTTSKASTTSKASTTSKASTTSKASTTSKASTTSKASTTSKVSTTSKASTTSKASTTSKASSTSKVSTTSKASTTSKVSAKATTSTKASTTVKPSTTSKASTTSKASTTSKASTTSKASTTSKASTTSKASTTSKASTTSKAATTSVKPTSKTSTSSKPNVSASSSNVGRDATSLVEASTSTSAAVLYPTTTSRWSNSTITRSSSLTTPIVSDPASLTTSVVYTTSVHTVTKCPAYVTDCPAGGYVTTETIPLYTTVCPISEATQTAAPTVTTEAPQPWTTSTVYTTRVYTITSCAPGVVDCPANQVTTETIPWYTTVCPVTATATPVGPGSVVFPQNTEVGQPSLVGPVVEAAYPTASSSLQTLVKPATSVGVPQGSPAGSSVAPGSSSKPTAPAGPPSYPTGGSGNASPSGSWSGVPVGPSSVPGIPEANAASVMSASLFGLVIVMAAQVFVL

SEQ ID NO: 490 - protein, 178 aa, Artificial Sequence
  Chain A, Structural Comparison Of Two Major Endo-1,4-Beta-Xylanases From Trichodrema Reesei 178 aa protein 1XYN_A GI:157834272
ASINYDQNYQTGGQVSYSPSNTGFSVNWNTQDDFVVGVGWTTGSSAPINFGGSFSVNSGTGLLSVYGWSTNPLVEYYIMEDNHNYPAQGTVKGTVTSDGATYTIWENTRVNEPSIQGTATFNQYISVRNSPRTSGTVTVQNHFNAWASLGLHLGQMNYQVVAVEGWGGSGSASQSVSN

SEQ ID NO: 491 - protein, 190 aa, Artificial Sequence
  xylanase, partial [Trichoderma reesei] ACB38137.1 GI:170786291
QTIQPGTGYNNGYFYSYWNDGHGGVTYTNGPGGQFSVNWSNSGNFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 492 - protein, 190 aa, Artificial Sequence; identical to SEQ ID NO: 464
  Chain A, Xylanase Ii From Trichoderma Reesei Cocrystallized With Tris- Dipicolinate Europium 190 aa protein 3LGR_A GI:319443539
  VARIANT 1: Xaa = Any Amino Acid

SEQ ID NO: 493 - protein, 189 aa, Artificial Sequence
  Chain A, Crystal Structures Of Mutant Endo- -1,4-xylanase Ii Complexed With Substrate (1.15 A) And Products (1.6 A) 189 aa protein 4HK8_A GI:572153255
TIQPGTGYNNGYFYSYWNDGHGGVTYTNGPGGQFSVNWSNSGNFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVQGYFSSGSASITVS

SEQ ID NO: 494 - protein, 188 aa, Artificial Sequence
  Chain A, Crystal Structures Of Mutant Endo-beta-1,4-xylanase Ii Complexed With Substrate (1.15 A) And Products (1.6 A) 188 aa protein 4HK9_A GI:572153256
IQPGTGYNNGYFYSYWNDGHGGVTYTNGPGGQFSVNWSNSGHFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 495 - protein, 189 aa, Artificial Sequence
  Chain A, Crystal Structures Of Mutant Endo-beta-1,4-xylanase Ii Complexed With Substrate (1.15 A) And Products (1.6 A) 189 aa protein 4HKL_A GI:572153257
TIQPGTGYNNGYFYSYWNDGHGGVTYTNGPGGQFSVNWSNSGHFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 496 - protein, 169 aa, Artificial Sequence
  Chain A, Crystal Structures Of Mutant Endo-beta-1,4-xylanase Ii (e177q) In The Apo Form 189 aa protein 4HKO_A GI:572153258
TIQPGTGYNNGYFYSYWNDGHGGVTYTNGPGGQFSVNWSNSGNFVGGKGWQPGTKNKVINNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVQGYFSSGSASITVS

SEQ ID NO: 497 - protein, 190 aa, Artificial Sequence; identical to SEQ ID NO: 464
  Chain A, Crystal Structures Of Mutant Endo-beta-1,4-xylanase Ii Complexed With Substrate And Products 190 aa protein 4HKW_A GI:572153259
  VARIANT 1: Xaa = Any Amino Acid

SEQ ID NO: 498 - protein, 190 aa, Artificial Sequence; identical to SEQ ID NO: 464
  Chain A, Joint X-ray/neutron Structure Of Trichoderma Reesei Xylanase Ii In Complex With Mes At Ph 5.7 190 aa protein 4S2D_A GI:929984639
  VARIANT 1: Xaa = Any Amino Acid

SEQ ID NO: 499 - protein, 190 aa, Artificial Sequence; identical to SEQ ID NO: 464
  Chain A, Joint X-ray/neutron Structure Of Trichoderma Reesei Xylanase Ii At Ph 4.4 190 aa protein 4S2F_A GI:929984640
  VARIANT 1: Xaa = Any Amino Acid

SEQ ID NO: 500 - protein, 190 aa, Artificial Sequence; identical to SEQ ID NO: 464
  Chain A, Joint X-ray/neutron Structure Of Trichoderma Reesei Xylanase Ii At Ph 5.8 190 aa protein 4S2G_A GI:929984641
  VARIANT 1: Xaa = Any Amino Acid

SEQ ID NO: 501 - protein, 190 aa, Artificial Sequence; identical to SEQ ID NO: 464
  Chain A, Joint X-ray/neutron Structure Of Trichoderma Reesei Xylanase Ii At Ph 8.5 190 aa protein 4S2H_A GI:929984642
  VARIANT 1: Xaa = Any Amino Acid

SEQ ID NO: 502 - protein, 189 aa, Artificial Sequence
  Chain A, X-ray Structure Analysis Of Xylanase - N44d 189 aa protein 4XQ4_A GI:929984784
TIQPGTGYNNGYFYSYWNDGHGGVTYTNGPGGQFSVNWSNSGDFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 503 - protein, 189 aa, Artificial Sequence; identical to SEQ ID NO: 502
  Chain B, X-ray Structure Analysis Of Xylanase - N44d 189 aa protein 4XQ4_B GI:929984785

SEQ ID NO: 504 - protein, 189 aa, Artificial Sequence
  Chain A, X-ray Structure Analysis Of Xylanase-wt At Ph4.0 189 aa protein 4XQD_A GI:929984786
TIQPGTGYNNGYFYSYWNDGHGGVTYTNGPGGQFSVNWSNSGNFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 505 - protein, 189 aa, Artificial Sequence; identical to SEQ ID NO: 504
  Chain B, X-ray Structure Analysis Of Xylanase-wt At Ph4.0 189 aa protein 4XQD_B GI:929984787

SEQ ID NO: 506 - protein, 189 aa, Artificial Sequence
  Chain A, X-ray Structure Analysis Of Xylanase-n44e With Mes At Ph6.0 189 aa protein 4XQW_A GI:929984788
TIQPGTGYNNGYFYSYWNDGHGGVTYTNGPGGQFSVNWSNSGEFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 507 - protein, 189 aa, Artificial Sequence; identical to SEQ ID NO: 502
  Chain A, Neutron And X-ray Structure Analysis Of Xylanase: N44d At Ph6 189 aa protein 4XPV_A GI:931139811

SEQ ID NO: 508 - protein, 28 aa, Artificial Sequence
  truncated xylanase 5 [Trichoderma reesei] 28 aa protein ANW82584.1 GI:1048222282
MVSFSSLVVALVGIASSWALWRNPSTQT

SEQ ID NO: 509 - protein, 28 aa, Artificial Sequence
  truncated xylanase 5 [Trichoderma reesei] 28 aa protein ANW82585.1 GI:1048222284
MVSFSSLVVALVGIASSWALWRNPSTQT

SEQ ID NO: 510 - protein, 226 aa, Artificial Sequence
  xylanase [Trichoderma reesei] 226 aa protein ANX99792.1 GI:1049178838
MVSFSSLVVALVGIASSWAAPLEESPNANITERGPSNFVLGGHNAVRRAAINYNQDYTTGGDVVYTHSNTGFAVNWSYPNDFVVGVGWNPGGSAPINFSGNFGVGSGVGLLSVYGWSTNPLVEYYVVEDNFGFSSGGTVKGSVTSDGSSYTIWENTRVNEPSIVGTATFNQYISIRNSKRSSGTVTVANHFNAWKSLGMNLGTMNYQVIAVEGWGGQGGVQQTVSN

SEQ ID NO: 511 - protein, 226 aa, Artificial Sequence
  xylanase [Trichoderma reesei] 226 aa protein ANX99793.1 GI:1049178840
MVSFSSLVVALVGIASSLAAPLEESLNANITERGPNNFVLGGHNAVRRAAINYNQDYTTGGDVVYTHSNTGFAVNWSYPNDFVVGVGWNPGGSAPINFSGNFGVGSGVGLLSVYGWSTNPLVEYYVVEDNFGFSSGGTVKGSVTSDGSSYTIWENTRVNEPSIVGTATFNQYISIRNSKRSSGTVTIANHFNAWKSLGMNLGTLNYQVIAVEGWGGQGGVQQTVSN

SEQ ID NO: 512 - protein, 226 aa, Artificial Sequence; identical to SEQ ID NO: 511
  xylanase [Trichoderma reesei] 226 aa protein ANX99794.1 GI:1049178842

SEQ ID NO: 513 - protein, 226 aa, Artificial Sequence; identical to SEQ ID NO: 511
  xylanase [Trichoderma reesei] 226 aa protein ANX99795.1 GI:1049178844

SEQ ID NO: 514 - protein, 190 aa, Artificial Sequence
  xylanase 2, partial [Trichoderma reesei] 190 aa protein APU51339.1 GI:1130479396
QTIQPGTGYNNGYCYSYWNDGHGGVTYTNGPGGQFSVNWSNSGNFVGGKGWCPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 515 - protein, 190 aa, Artificial Sequence; identical to SEQ ID NO: 491
  xylanase 2, partial [Trichoderma reesei] 190 aa protein APU51340.1 GI:1130479398

SEQ ID NO: 516 - protein, 190 aa, Artificial Sequence; identical to SEQ ID NO: 491
  Chain A, Microed Structure Of Xylanase At 2.3 A Resolution 190 aa protein 5K7P_A GI:1175128641

SEQ ID NO: 517 - protein, 411 aa, Artificial Sequence; identical to SEQ ID NO: 487
  glycoside hydrolase family 18, chitinase [Trichoderma reesei QM6a] 411 aa protein EGR44650.1 GI:340514387

SEQ ID NO: 518 - protein, 473 aa, Artificial Sequence
  glycoside hydrolase family 5 [Trichoderma reesei QM6a] 473 aa protein EGR44819.1 GI:340514558
MKSSISVVLALLGHSAAWSYATKSQYRANIKINARQTYQTMIGGGCSGAFGIACQQFGSSGLSPENQQKVTQILFDENIGGLSIVRNDIGSSPGTTILPTCPATPQDKFDYVWDGSDNCQFNLTKTALKYNPNLYVYADAWSAPGCMKTVGTENLGGQICGVRGTDCKHDWRQAYADYLVQYVRFYKEEGIDISLLGAWNEPDFNPFTYESMLSDGYQAKDFLEVLYPTLKKAFPKVDVSCCDATGARQERNILYELQQAGGERYFDIATWHNYQSNPERPFNAGGKPNIQTEWADGTGPWNSTWDYSGQLAEGLQWALYMHNAFVNSDTSGYTHWWCAQNTNGDNALIRLDRDSYEVSARLWAFAQYFRFARPGSVRIGATSDVENVYVTAYVNKNGTVAIPVINAAHFPYDLTIDLEGIKKRKLSEYLTDNSHNVTLQSRYKVSGSSLKVTVEPRAMKTFWLEPQSTFAVI

SEQ ID NO: 519 - protein, 223 aa, Artificial Sequence
  glycoside hydrolase family 11 [Trichoderma reesei QM6a] 223 aa protein EGR45030.1 GI:340514771
MVSFTSLLAGVAAISGVLAAPAAEVESVAVEKRQTIQPGTGYNNGYFYSYWNDGHGGVTYTNGPGGQFSVNWSNSGNFVGGKGWQPGTKNKVINFSGSYNPNGNSYLSVYGWSRNPLIEYYIVENFGTYNPSTGATKLGEVTSDGSVYDIYRTQRVNQPSIIGTATFYQYWSVRRNHRSSGSVNTANHFNAWAQQGLTLGTMDYQIVAVEGYFSSGSASITVS

SEQ ID NO: 520 - protein, 401 aa, Artificial Sequence; identical to SEQ ID NO: 488
  glycoside hydrolase family 18, chitinase [Trichoderma reesei QM6a] 401 aa protein EGR45486.1 GI:340515230

SEQ ID NO: 521 - protein, 919 aa, Artificial Sequence
  xylanase regulator 1 [Trichoderma reesei QM6a] 920 aa protein EGR48040.1 GI:340517797
MLSNPLRRYSAYPDISSASFDPNYHGSQSHLHSINVNTFGNSHPYPMQHLAQHAELSSSRMIRASPVQPKQRQGSLIAARKNSTGTAGPIRRRISRACDQCNQLRTKCDGLHPCAHCIEFGLGCEYVRERKKRGKASRKDIAAQQAAAAAAQHSGQVQDGPEDQHRKLSRQQSESSRGSAELAQPAHDPPHGHIEGSVSSFSDNGLSQHAAMGGMDGLEDHHGHVGVDPALGRTQLEASSAMGLGAYGEHPGYESPGMNGHVMVPPSYGAQTTMAGYSGISYAAQAPSPATYSSDGNFRLTGHIHDYPLANGSSPSWGQSDLRYPVLEPLLPHLGNILPVSLACDLIDLYFSSSSSAQMHPMSPYVLGFVFRKRSFLHPTNPRRCQPALLASMLWVAAQTSEASFLTSLPSARSKVCQKLLELTVGLLQPLIHTGTNSPSPKTSPVVGAAALGVLGVAMPGSLNMDSLAGETGAFGAIGSLDDVITYVHLATVVSASEYKGASLRWWGAAWSLARELKLGRELPPGNPPANQEDGEGLSEDVDEHDLNRNNTRFVTEEEREERRRAWWLVYIVDRHLALCYNRPLFLLDSECSDLYHPMDDIKWQAGKFRSHDAGNSSINIDSSMTDEFGDSPRAARGAHYECRGRSIFGYFLSLMTILGEIVDVHHAKSHPRFGVGFRSARDWDEQVAEITRHLDMYEESLKRFVAKHLPLSSKDKEQHEMHDSGAVTDMQSPLSVRTNASSRMTESEIQASIVVAYSTHVMHVLHILLADKWDPINLLDDDDLWISSEGFVTATSHAVSAAEAISQILEFDPGLEFMPFFYGVYLLQGSFLLLLIADKLQAEASPSVIKACETIVRAHEACVVTLSTEYQRNFSKVMRSALALIRGRVPEDLAEQQQRRRELLALYRWTGNGTGLAL

SEQ ID NO: 522 - protein, 241 aa, Artificial Sequence
  predicted protein, partial [Trichoderma reesei QM6a] 241 aa protein EGR49987.1 GI:340519749
LRILPVGDSITYGFLSDQDGGDGNGYRLQLRQHLSKDRVVFAGTETSGNMTDGYYLIVSSSLHRQAAWNGKTIQYISDHVTPSLEQRPNIILLHAGTNDMNPNGAISREGHDPVAASERLGSLVDKMTTLCPDAVILVAMIIGTCNDEQAPQTKVFQSLIPNVVAPRLESGKHVLAVDFSTFPLDKLRDCIHPTNEGYHLLGYYWYDFIAQIPRDWITAPVGEDPQRPEEQNLAMRLETDL

SEQ ID NO: 523 - protein, 733 aa, Artificial Sequence
  transcription factor [Trichoderma reesei QM6a] 733 aa protein EGR51484.1 GI:340521249
MSFSNPRRRTPVTRPGTDCEHGLSLKTTMTLRKGATFHSPTSPSASSAAGDFVPPTLTRSQSAFDDVVDASRRRIAMTLNDIDEALSKASLSDKSPRPKPLRDTSLPVPRGFLEPPVVDPAMNKQEPERRVLRPRSVRRTRNHASDSGIGSSVVSTNDKAGAADSTKKPQASALTRSAASSTTAMLPSLSHRAVNRIREHTLRPLLEKPTLKEFEPIVLDVPRRIRSKEIICLRDLEKTLIFMAPEKAKSAALYLDFCLTSVRCIQATVEYLTDREQVRPGDRPYTNGYFIDLKEQIYQYGKQLAAIKEKGSLADDMDIDPSDEVRLYGGVAENGRPAELIRVKKDGTAYSMATGKIVDMTESPTPLKRSLSEQREDEEEIMRSMARRKKNATPEELAPKKCREPGCTKEFKRPCDLTKHEKTHSRPWKCPIPTCKYHEYGWPTEKEMDRHINDKHSDAPAMYECLFKPCPYKSKRESNCKQHMEKAHGWTYVRTKTNGKKAPSQNGSTAQQTPPLANVSTPSSTPSYSVPTPPQDQVMSTDFPMYPADDDWLATYGAQPNTIDAMDLGLENLSPASAASSYEQYPPYQNGSTFIINDEDIYAAHVQIPAQLPTPEQVYTKMMPQQMPVYHVQQEPCTTVPILGEPQFSPNAQQNAVLYTPTSLREVDEGFDESYAADGADFQLFPATVDKTDVFQSLFTDMPSANLGFSQTTQPDIFNQIDWSNLDYQGFQE

SEQ ID NO: 524 - protein, 347 aa, Artificial Sequence
  glycoside hydrolase family 10 [Trichoderma reesei QM6a] 347 aa protein EGR52056.1 GI:340521822
MKANVILCLLAPLVAALPTETIHLDPELAALRANLTERTADLWDRQASQSIDQLIKRKGKLYFGTATDRGLLQREKNAAIIQADLGQVTPENSMKWQSLENNQGQLNWGDADYLVNFAQQNGKSIRGHTLIWHSQLPAWVNNINNADTLRQVIRTHVSTVVGRYKGKIRAWDVVNEIFNEDGTLRSSVFSRLLGEEFVSIAFRAARDADPSARLYINDYNLDRANYGKVNGLKTYVSKWISQGVPIDGIGSQSHLSGGGGSGTLGALQQLATVPVTELAITELDIQGAPTTDYTQVVQACLSVSKCVGITVWGISDKDSWRASTNPLLFDANFNPKPAYNSIVGILQ

SEQ ID NO: 525 - protein, 401 aa, Artificial Sequence; identical to SEQ ID NO: 486
  glycoside hydrolase family 18, chitinase [Trichoderma reesei QM6a] 401 aa protein EGR52465.1 GI:340522232

SEQ ID NO: 526 - protein, 324 aa, Artificial Sequence; identical to SEQ ID NO: 484
  glycoside hydrolase family 18 [Trichoderma reesei QM6a] 324 aa protein EGR52759.1 GI:340522526

SEQ ID NO: 527 - protein, 229 aa, Artificial Sequence; identical to SEQ ID NO: 462
  glycoside hydrolase family 11 [Trichoderma reesei QM6a] 229 aa protein EGR52985.1 GI:340522752

SEQ ID NO: 528 - protein, 324 aa, Artificial Sequence; identical to SEQ ID NO: 484
  glycoside hydrolase family 18 [Trichoderma reesei QM6a] 324 aa protein P_006961069.1 I:589098093

SEQ ID NO: 529 - protein, 401 aa, Artificial Sequence; identical to SEQ ID NO: 486
  glycoside hydrolase family 18, chitinase [Trichoderma reesei QM6a] 41 aa protein XP_006961376.1 I:589098707

SEQ ID NO: 530 - protein, 229 aa, Artificial Sequence; identical to SEQ ID NO: 462
  glycoside hydrolase family 11 [Trichoderma reesei QM6a] 229 aa protein XP_006961811.1 I:589099577

SEQ ID NO: 531 - protein, 347 aa, Artificial Sequence; identical to SEQ ID NO: 524
  glycoside hydrolase family 10 [Trichoderma reesei QM6a] 347 aa protein XP_006962419.1 GI:589100793

SEQ ID NO: 532 - protein, 733 aa, Artificial Sequence; identical to SEQ ID NO: 523
  transcription factor [Trichoderma reesei QM6a] 733 aa protein XP_006962963.1 GI:589101881

SEQ ID NO: 533 - protein, 241 aa, Artificial Sequence; identical to SEQ ID NO: 522
  predicted protein, partial [Trichoderma reesei QM6a] 241 aa protein XP_006964048.1 GI:589104051

SEQ ID NO: 534 - protein, 920 aa, Artificial Sequence
  xylanase regulator 1 [Trichoderma reesei QM6a] 920 aa protein XP_006966092.1 GI:589108139
MLSNPLRRYSAYPDISSASFDPNYHGSQSHLHSINVNTFGNSHPYPMQHLAQHAELSSSRMIRASPVQPKQRQGSLIAARKNSTGTAGPIRRRISRACDQCNQLRTKCDGLHPCAHCIEFGLGCEYVRERKKRGKASRKDIAAQQAAAAAAQHSGQVQDGPEDQHRKLSRQQSESSRGSAELAQPAHDPPHGHIEGSVSSFSDNGLSQHAAMGGMDGLEDHHGHVGVDPALGRTQLEASSAMGLGAYGEVHPGYESPGMNGHVMVPPSYGAQTTMAGYSGISYAAQAPSPATYSSDGNFRLTGHIHDYPLANGSSPSWGQSDLRYPVLEPLLPHLGNILPVSLACDLIDLYFSSSSSAQMHPMSPYVLGFVFRKRSFLHPTNPRRCQPALLASMLWVAAQTSEASFLTSLPSARSKVCQKLLELTVGLLQPLIHTGTNSPSPKTSPVVGAAALGVLGVAMPGSLNMDSLAGETGAFGAIGSLDDVITYVHLATVVSASEYKGASLRWWGAAWSLARELKLGRELPPGNPPANQEDGEGLSEDVDEHDLNRNNTRFVTEEEREERRRAWWLVYIVDRHLALCYNRPLFLLDSECSDLYHPMDDIKWQAGKFRSHDAGNSSINIDSSMTDEFGDSPRAARGAHYECRGRSIFGYFLSLMTILGEIVDVHHAKSHPRFGVGFRSARDWDEQVAEITRHLDMYEESLKRFVAKHLPLSSKDKEQHEMHDSGAVTDMQSPLSVRTNASSRMTESEIQASIVVAYSTHVMHVLHILLADKWDPINLLDDDDLWISSEGFVTATSHAVSAAEAISQILEFDPGLEFMPFFYGVYLLQGSFLLLLIADKLQAEASPSVIKACETIVRAHEACVVTLSTEYQRNFSKVMRSALALIRGRVPEDLAEQQQRRRELLALYRWTGNGTGLAL

SEQ ID NO: 535 - protein, 401 aa, Artificial Sequence; identical to SEQ ID NO: 488
  glycoside hydrolase family 18, chitinase [Trichoderma reesei QM6a] 401 aa protein XP_006968673.1 GI:589113301

SEQ ID NO: 536 - protein, 223 aa, Artificial Sequence; identical to SEQ ID NO: 519
  glycoside hydrolase family 11 [Trichoderma reesei QM6a] 223 aa protein XP_006968947.1 GI:589113849

SEQ ID NO: 537 - protein, 473 aa, Artificial Sequence; identical to SEQ ID NO: 518
  glycoside hydrolase family 5 [Trichoderma reesei QM6a] 473 aa protein XP_006969226.1 GI:589114407

SEQ ID NO: 538 - protein, 411 aa, Artificial Sequence; identical to SEQ ID NO: 487
  glycoside hydrolase family 18, chitinase [Trichoderma reesei QM6a] 411 aa protein XP_0069693971. GI:589114749

SEQ ID NO: 539 - protein, 302 aa, Artificial Sequence
  Chain A, Crystal Structure Of An Endo-beta-1,4-xylanase (glycoside Hydrolase Family 10/gh10) Enzyme From Trichoderma Reesei 302 aa protein 4XV0_A GI:756143139
  VARIANT 1: Xaa = Any Amino Acid
XASQSIDQLIKRKGKLYFGTATDRGLLQREKNAAIIQADLGQVTPENSMKWQSLENNQGQLNWGDADYLVNFAQQNGKSIRGHTLIWHSQLPAWVNNINNADTLRQVIRTHVSTVVGRYKGKIRAWDVVNEIFNEDGTLRSSVFSRLLGEEFVSIAFRAARDADPSARLYINDYNLDRANYGKVNGLKTYVSKWISQGVPIDGIGSQSHLSGGGGSGTLGALQQLATVPVTELAITELDIQGAPTTDYTQVVQACLSVSKCVGITVWGISDKDSWRASTNPLLFDANFNPKPAYNSIVGILQ

SEQ ID NO: 540 - protein, 229 aa, Artificial Sequence; identical to SEQ ID NO: 462
  Endo-1,4-beta-xylanase G0R947.1 GI:1042851765

SEQ ID NO: 541 - protein, 223 aa, Artificial Sequence; identical to SEQ ID NO: 519
  Endo-beta-1,4-xylanase 223 aa protein GRUP7.1 GI:142851766

SEQ ID NO: 542 - protein, 347 aa, Artificial Sequence; identical to SEQ ID NO: 524
  RecName: Full=Endo-1,4-beta-xylanase 3; Short= Xylanase 3; AltName: Full=1,4-beta-D-xylan xylanohydrolase 3; Flags: Precursor 347 aa protein G0RA32.1 GI:1042851767

SEQ ID NO: 543 - protein, 229 aa, Artificial Sequence; identical to SEQ ID NO: 462
  Endo-beta-1,4-xylanase: P36218.1 GI:549460

SEQ ID NO: 544 - protein, 411 aa, Artificial Sequence; identical to SEQ ID NO: 487
  hypothetical protein M419DRAFT_104468 [Trichoderma reesei RUT C-30] 411 aa protein ETR97430.1 GI:572273844

SEQ ID NO: 545 - protein, 229 aa, Artificial Sequence; identical to SEQ ID NO: 462
  endo beta-1,4-xylanase isotype 2 [Trichoderma reesei RUT C-30] 229 aa protein ETR98398.1 GI:572274931

SEQ ID NO: 546 - protein, 401 aa, Artificial Sequence; identical to SEQ ID NO: 486
  hypothetical protein M419DRAFT_114979 [Trichoderma reesei RUT C-30] 401 aa protein ETR98463.1 GI:572274996

SEQ ID NO: 547 - protein, 401 aa, Artificial Sequence; identical to SEQ ID NO: 488
  hypothetical protein M419DRAFT_133349 [Trichoderma reesei RUT C-30] 401 aa protein ETR98658.1 GI:572275208

SEQ ID NO: 548 - protein, 827 aa, Artificial Sequence
  glycoside hydrolase [Trichoderma reesei RUT C-30] 827 aa protein ETS00190.1 GI:572276883
MVSASAGLAAVGLLNGYWGQYTTTEGLRPHCDSGVDSITLGFVNGAPDASGYPSLNFGPNCWAESYPGNLGLPSKLLSHCMSLQSDIPYCRSKGVKVILSIGGVYNALTSNYFVGDNGTATDFATFLYNAFGPYNASYTGPRPFDDITTGLPTSVDGFDFDIEADFPNGPYIKMIETFRSLDSSMLITGAPQCPTNPQYFVMKDMIQQAAFDKLFIQFYNNPVCDAIPGNTAGDKFNYDDWEAVIAGSAKSKSAKLYIGLPAIQEPNESGYIDPIAMKNLVCQYKDRPHFGGLSLWDLSRGLVNNINGTSFNQWALDALQYGCNPIPTTTTTTSTASSTSKASTTSKASTTSKASTTSKASTTSKASTTSKASTTSKASTTSKASTTSKASTTSKASTTSKASTTSKASTTSKVSTTSKASTTSKASTTSKASSTSKVSTTSKASTTSKVSAKATTSTKASTTVKPSTTSKASTTSKASTTSKASTTSKASTTSKASTTSKASTTSKASTTSKAATTSVKPTSKTSTSSKPNVSASSSNVGRDATSLVEASTSTSAAVLYPTTTSRWSNSTITRSSSLTTPIVSDPASLTTSVVYTTSVHTVTKCPAYVTDCPAGGYVTTETIPLYTTVCPISEATQTAAPTVTTEAPQPWTTSTVYTTRVYTITSCAPGVVDCPANQVTTETIPWYTTVCPVTATATPVGPGSVVFPQNTEVGQPSLVGPVVEAAYPTASSSLQTLVKPATSVGVPQGSPAGSSVAPGSSSKPTAPAGPPSYPTGGSGNASPSGSWSGVPVGPSSVPGIPEANAASVMSASLFGLVIVMAAQVFVL

SEQ ID NO: 549 - protein, 920 aa, Artificial Sequence; identical to SEQ ID NO: 534
  xylanase regulator 1 [Trichoderma reesei RUT C-30] 920 aa protein ETS02023.1 GI:572278872

SEQ ID NO: 550 - protein, 267 aa, Artificial Sequence
  SGNH hydrolase [Trichoderma reesei RUT C-30] 267 aa protein ETS03411.1 GI:572280314
MLLVQVRPSSSPAIDLIRGTELRILPVGDSITYGFLSDQDGGDGNGYRLQLRQHLSKDRVVFAGTETSGNMTDGYYAAWNGKTIQYISDHVTPSLEQRPNIILLHAGTNDMNPNGAISREGHDPVAASERLGSLVDKMTTLCPDAVILVAMIIGTCNDEQAPQTKVFQSLIPNVVAPRLESGKHVLAVDFSTFPLDKLRDCIHPTNEGYHLLGYYWYDFIAQIPRDWITAPVGEDPQRPEEQNLAMRLETDLLLLGLLGLLVVLMYA

SEQ ID NO: 551 - protein, 347 aa, Artificial Sequence; identical to SEQ ID NO: 524
  xylanase III [Trichoderma reesei RUT C-30] 347 aa protein ETS05245.1 GI:572282231

SEQ ID NO: 552 - protein, 324 aa, Artificial Sequence; identical to SEQ ID NO: 484
  hypothetical protein M419DRAFT_94061 [Trichoderma reesei RUT C-30] 324 aa protein ETS6436.1 GI:572283462

SEQ ID NO: 553 - protein, 223 aa, Artificial Sequence; identical to SEQ ID NO: 519
  Endo-1,4-beta-xylanase 2; Precursor 223 aa protein P36217.2 GI:1042782319

SEQ ID NO: 554 - protein, 347 aa, Artificial Sequence; identical to SEQ ID NO: 524
  RecName: Full=Endo-1,4-beta-xylanase 3; Short=Xylanase 3; AltName: Full=1,4-beta-D-xylan xylanohydrolase 3; Flags: Precursor 347 aa protein A0A024SIB3.1 GI:1042851768

SEQ ID NO: 555-575 - skipped (21 entries)

SEQ ID NO: 576 - protein, 9 aa, Artificial Sequence
  2D98_A GI:112490433
SGSASITVS

SEQ ID NO: 577-579 - skipped (3 entries)

SEQ ID NO: 580 - protein, 401 aa, Artificial Sequence; identical to SEQ ID NO: 486
  TPA_inf: chitinase 18-13 [Trichoderma reesei] 41 aa protein DAA5861.1 GI:1232265

SEQ ID NO: 581-676 - skipped (96 entries)

SEQ ID NO: 677 - protein, 347 aa, Artificial Sequence; identical to SEQ ID NO: 524
  RecName: Full=Endo-1,4-beta-xylanase 3; Short=Xylanase 3; AltName: Full=1,4-beta-D-xylan xylanohydrolase 3; Flags: Precursor 347 aa protein

SEQ ID NO: 678 - protein, 994 aa, Artificial Sequence
  beta-galactosidase [Aspergillus niger] 994 aa protein AOV94178.1 GI:1078570522
MKLQSILSCWAILVAQIWATTDGLTDLVAWDPYSLTVNGNRLFVYSGEFHYPRLPVPEMWLDVFQKMRAHGFNAVSLYFFWDYHSPINGTYDFETGAHNIQRLFDYAQEAGIYIIARAGPYCNAEFNGGGLALYLSDGSGGELRTSDATYHQAWTPWIERIGKIIAENSITNGGPVILNQIENELQETTHSASNTLVEYMEQIEEAFRAAGVDVPFTSNEKGQRSRSWSTDYEDVGGAVNVYGLDSYPGGLSCTNPSTGFSVLRNYYQWFQNTSYTQPEYLPEFEGGWFSAWGADSFYDQCTSELSPQFADVYYKNIIGQRVTLQNLYMLYGGTNWGHLAAPVVYTSYDYSAPLRETRQIRDKLSQTKLVGLFTRVSSGLLGVEMEGNGTSYTSTTSAYTWVLRNPNTTAGFYVVQQDTTSSQTDITFSLNVNTSAGAFTLPNINLQGRQSKVISTDYPLGHSTLLYVSTDIATYGTFGDTDVVVLYARSGQEVSFSFKNTTKLTFEEYGDSVNLTSSSGNRTITSYTYTQGSGTSVVKFSNGAIFYLVETETAFRFWAPPTTTDPYVTAEQQIFVLGPYLVRNVSISGSVVDLVGDNDNATTVEVFAGSSAKAVKWNGKEITVTKTDYGSLVGSIGGADSSSITIPSLTGWKVRDSLPEIQSSYDDSKWTVCNKTTTLSPVDPLSLPVLFASDYGYYTGIKIYRGRFDGTNVTGANLTAQGGLAFGWNVWLNGDLVASLPGDADETSSNAAIDFSNHTLKQTDNLLTVVIDYTGHDETSTGDGVENPRGLLGATLNGGSFTSWKIQGNAGGAAGAYELDPVRAPMNEGGLLAERQGWHLPGYKAKSSDGWTDGSPLDGLNKSGVAFYLTTFTLDLPKNYDVPLGIQFTSPSTVDPVRIQLFINGYQYGKYVPYLGPQTTFPIPPGIINNRDKNTIGLSLWAQTDAGAKLENIELISYGAYESGFDAGNGTGFDLNGAKLGYQPEWTEARAKYT

SEQ ID NO: 679 - protein, 1014 aa, Artificial Sequence
  beta-galactosidase [Aspergillus niger] 1014 aa protein AOV94179.1 GI:1078570524
MTRITKLCVLLLSSIGLLAAAQNQTETGWPLHDDGLTTDVQWDHYSFKVHGERIFVFSGEFHYWRIPVPGLWRDILEKIKAAGFTTFAFYSSWAWHAPNNHTVDFSTGARDITPIFELAKELGMYIIVRPGPYINAEASAGGFPLWLTTGDYGTLRNNDSRYTEAWKPYFEKMTEITSRYQITNGHNTFCYQIENEYGDQWLSDPSERVPNETAIAYMELLESSARENGILVPFTANDPNMNAMAWSRDWSNAGGNVDVVGLDSYPSCWTCDVSQCTSTNGEYVAYQVVEYYDYFLDFSPTMPSFMPEFQGGSYNPWAGPEGGCGDDTGVDFVNLFYRWNIAQRVTAMSLYMLYGGTNWGAIAAPVTATSYDYSSPISEDRSISSKYYETKLLSLFTRSARDLTMTDLIGNGTQYTNNTAVKAYELRNPTTNAGFYVTLHEDSTVGTNEAFNLRVNTSAGNLIVPRRGGSIRLNGHQSKIIVTDFTFGSETLLYSTAEVLTYAVIDKKPTLVLWVPTGESGEFAVKGAKSGSVVSKCQSCPAINFHQQGGNLIVGFTQFQGMSVVQIDNDIRVVLLDRTAAYKFWAPALTEDPLVPEDEAVLIQGPYLVRSASLEKSTLAIKGDSINETAVEIFAPENVKTITWNGKQLKTSKSSYGSLKATIAAPASIQLPAFTSWKVNDSLPERLPTYDASGPAWVDANHMTTANPSKPATLPVLYADEYGFHNGVRLWRGYFNGTASGVFLNVQGGSAFGFSAYLNGHFLGSYLGNASIEQANQTFLFPNNITHPTTQNTLLVIHDDTGHDETTGALNPRGILEARLLPSDTTNNSTSPEFTHWRIAGTAGGESNLDPVRGAWNEDGLYAERVGWHLPGFDDSTWSSASSSLSFTGATVKFFRTTIPLDIPRGLDVSISFVLGTPDNAPNAYRAQLFVNGYQYGRFNPYIGNQVVFPVPVGVLDYTGENTIGVAVWAQTEDGAGITVDWKVNYVADSSLDVSGLETGELRPGWSAERLKFA

SEQ ID NO: 680 - protein, 1030 aa, Artificial Sequence
  beta-galactosidase [Aspergillus niger] 1030 aa protein AOV94180.1 GI:1078570526
MKTSFLLAIGLAVEACLGLVSAPNYVRQINATDSSLQDIVTWDEYSIRVRGERILLLLGEFHPFRLPCPGLWLDVFQKVRALGFSAVSFYVDWALLEGERGSIRADGVFALEEFFQAATEAGLYLTARPGPYINAEVSGGGFPGWLKRVQGRLKTTDQGYLDAITPYMQAIGRIIAKAQITNGGPVILFQPENEYTACVQDEGYTQVSNYSMPDINSSCLQKEYMAYVEEQYRKAGIVVPFIVNDADPMGNFAPGTGVGAVDIYSFDDYPLQWSTAPSNPSNWSSLISPLLSYNETVHEEQSPTTPFSISEFQGGVPDAWGGVGIETSAAYIGPEFERIFYKINYGFRAAIQNLYMIFGGTNWGNLGHSGGYTSYDVGAAIAEDRQVIREKYSELKLQSNFLQASSAYLETHSDNGSYGIYTDATSLAVTRLAGNPTNFYVVRHGELTSRESTSYKLRVNTSAGNLAIPQLSGSLSLHGRDSKIHLVDYNVGNVSLIYSTAELFTWKQAGSKSVVVLYGGEDELHEFAVPANKGKPTSIEGDGLQVQQINSTTVIQWAVQPSRRVVHFSDTLEVHLLWRNEAYNYWVLDLPVPGAIGRHVSRSHTNRSVIVKAGYLLRTAEIIGTSLYLTGDINTTTTIELISAPQPVTSILFNKNRIPTTITSPGRLTGTLTYHKPNISLPDLTTLDWYYLNTLPEVHDPTYDDHLWTPCTHTTTANPRNLTTPTSLYASDYGYNGGTLLYRGTFTATGNETSLYLLTEGGYAYGHSIWLNNTFLASWPGNPAFLLSNQTITFPSPLTPGTTYKLTILIDHLGNDENFPANGEFMKDPRGILDYTLHGRDDKSAISWKMTGNFGGESYADLSRGPLNEGALFAERKGYHLPGAPTEQWTKRSPFDGLPEDERPGVGFFATKFDLQIPDGYDVPISVVFENSTMAGDGSGPARFRSELFVNGWQFGKYVNHIGPQLSYPVPEGILNYNGSNYLALTIWAMDEKSFKLDGLRLQANAVVQSGYRKPSLVKGEVYKERVDSY

SEQ ID NO: 681 - protein, 81 aa, Artificial Sequence
  lactase B [Aspergillus luchuensis] 81 aa protein GAT22890.1 GI:1002328951
MTLQCKLESACSSTPHNAMVSVLQQDQWAGEPAEQQPHLSAVAAMGRDNECTMFEPGLSGHLLRGGHEATQVRNMVIEILF

SEQ ID NO: 682 - protein, 1015 aa, Artificial Sequence
  lactase B [Aspergillus luchuensis] 1015 aa protein GAT26827.1 GI:1002325961
MTRITKLCALLLSSTGLLAAAQNQTETGWPLYDDGLTTDIQWDHYSFKVHGERIFVFSGEFHYWRIPVPGLWRDILEKIKAAGFTTFSIYSSWAWHAPNNHTVDFSTGARDITPIFELAKELGMYIIVRPGPYINAEASAGGFPLWLTTGDYGTLRNNDSRYTAAWKPYFEKMTEITSRYQVTNGHNTFCYQIENEYGDQWLSDPSERVPNETAIAYMELLESSARENGILVPFTANDPNMNAMAWSRDWSNAGGNVDVVGLDSYPSCWTCDVSQCTSTNGEYVAYQVVEYYDYFLEFSPTMPSFMPEFQGGSYNPWAGPEGGCGDDTGVDFVNLFYRWNIAQRVTAMSLYMLYGGTNWGAIAAPVTATSYDYSSPISEDRSISSKYYETKLLSLFTRSARDLTMTDLIGNGTQYTNNTAVKAYELRNPTTNAGFYVTLHEDSTVGTNEAFSLRVNTSAGNLIVPRLGGSIRLNGHQSKIIVTDFTFGSETLLYSTAEVLTYAVLDKKPTLVLWVPTGESGEFAVKGAKSGSVVSKCQDCSAINFHQQGGNLVVGFTQAQGMSIVQIDNDIRVILLDRTAAYEFWAPALTEDPLVPEDEAVLIQGPYLVRSASLEKSTLAIKGDSINETAVEIFAPNDVKTVTWNGKQLKTSKSSYGSLKATIAAPVSIQLPAFTSWKVNDSLPERLPTYDASGLAWVDANHMTTANPSKPATLPVLCADEYGFHNGVRLWRGYFNGTASGVFLNVQGGSAFGFSAYLNGQFLGSYLGNASIEQANQTFVFPTNITHPTTQNTLLIIHDDTGHDETTGALNPRGILEARLLPSTTTDNTASPEFTHWRLAGTAGGESNLDPVRGAWNEDGLYAERVGWHLPGFDDSTWPSVSSSSLSFTGATVKFFRTTIPLNIPRGLDVSISFVLGTPDNAPNTYRAQLFVNGYQYGRFNPYIGNQVVFPVPVGVLDYSGENTIGVAVWAQTEDGAAITVDWKVNYVADSSLDVAGLETAGLRPGWSVERLKFA

SEQ ID NO: 683 - protein, 726 aa, Artificial Sequence
  Putative Lactase B [Aspergillus calidoustus] 726 aa protein CEN62581.1 GI:972234022
MPFFMPEFQGGSYNPWDGPEGGCTEDTGAEFANLFYRWNIAQRVTAMSLYMMYGGTNWGGLAAPVTATSYDYSAPISEDRSIGSKYYETKLLALFTRCAKDLTMTDRIDNGTQYTTNAAISATELRNPETNAAFYVTNHLDTTLGTDESFKLHVDTSEGALTIPKHGGAIRLNGHQSKIIVTDFRLGRETLLYSTAEVLTYAVFDKKPTLVLWVPAGESGEFAIKGAKRGSATTCSDCSPVEFHRSKESLTVSFTQADGISIVQLDNGVRVLLLDRPSAYTFWAPALTDDPLVPETESVFVSGPYLVRSAKLSGSTLALRGDSNGKTAIEVFAPKKVNKITWNGRRIKVTKTRYGSLKASLASAPSIELPALDGWKVSDSLPERLPAYDDSGAAWVDADHMTTPNPHKPATLPVLYADEYGFHNGVRLWRGYFNSSASGVFLNIQGGAAFGWSAYLNGHFLDSYLGDASTNQANGTLSFPDDTLNTDGTPNVLLVIHDDTGHDQTTGVLNPRGILEARLLPLDTESDTEAPEFTHWRVAGTAGGESDLDPVRGVYNEDGLFAERVGWHLPGFDDDDWPAANNSLSFTGATVKFFRTVIPPLDIPQGVDVSISFVFSASSGGNSSSSSSSTGGNTRAFRAQLFVNGYQYGRFNPYVGNQIVYPVPPGILDYNGENTIGVAVWAQTEAGASLELDWRVNYVVDSSLDVANLDVGGLRPEWEEERLSFA

SEQ ID NO: 684 - protein, 506 aa, Artificial Sequence
  beta-glucosidase, lactase phlorizinhydrolase [Aspergillus oryzae 100-8] 506 aa protein KDE76127.1 GI:635504017
MNVNMFKAGDDILQDVDQSCKDRLPAVEELPLPPTFTWGTATAAYQVEGGAFQDGKGKSIWDTFTHLDPSRTNGENGDIACDHYNRMAEDVVLMASYGVDVYRFSIAWARILPLGGRGDPINEKGIAFYNNLIDCLLEHNIEPVVTLYHWDVPQGLYDRYGAFLDTTEFRADFEHFARLCFSRFGDRVKRWITFNEPYIIAIFGHHSGVLAPGRSSATGGDSRTEPWRVGHTIILAHTAAVQAYATDFQPTQKGDISIVLNGHYYEPWDAGSEEHWLAAQRRLEFYIGWFGDPIFLGKDYPAPMRAQLGSRLPEFTSEELDLLRRSAPINSFYGMNHYTTKYARALPDPPAEDDCTGNVEEGPTNSEGKTMGPLSGMSWLRVTPAGFRKLLNWVWDRYRRPIVVTENGCPCPGESQMTKEQALDDQFRIRYFGLYLDAISRAIYDDGVKVEGYYVWSLMDNFEWSAGYGPRYGITHVDFTTLVRTPKQSAKYLHHSFNKRRATSLR

SEQ ID NO: 685 - protein, 483 aa, Artificial Sequence
  beta-glucosidase, lactase phlorizinhydrolase [Aspergillus oryzae 3.042] 483 aa protein EIT76661.1 GI:391867415
MGSTSTSTLPPDFLWGFATASYQIEGAVNEDGRGPSIWDTFCKIPGKIAGGANGDVACDSYHRTHEDIALLKACGAKAYRFSLSWSRIIPLGGRNDPINEKGLQYYIKFVDDLHAAGITPLVTLFHWDLPDELDKRYGGLLNKEEFVADFAHYARIVFKAFGSKVKHWITFNEPWCSSVLGYNVGQFAPGRTSDRSKSPVGDSSRECWIVGHSLLVAHGAAVKIYRDEFKASDGGEIGITLNGDWAEPWDPENPADVEACDRKIEFAISWFADPIYHGKYPDSMVKQLGDRLPKWTPEDIALVHGSNDFYGMNHYCANFIKAKTGEADPNDTAGNLEILLQNRKGEWVGPETQSPWLRPSAIGFRKLLKWLSERYNYPKIYVTENGTSLKGENDLPLEQLLQDDFRTQYFRDYIGAMADAYTLDGVNVRAYMAWSLMDNFEWAEGYETRFGVTYVDYENNQKRIPKQSAKAIGEIFDQYIEKA

SEQ ID NO: 686 - protein, 506 aa, Artificial Sequence; identical to SEQ ID NO: 684
  beta-glucosidase, lactase phlorizinhydrolase [Aspergillus oryzae 3.42] 56 aa protein EIT82651.1 GI:391873626

SEQ ID NO: 687 - protein, 506 aa, Artificial Sequence; identical to SEQ ID NO: 684
  beta-glucosidase, lactase phlorizinhydrolase [Aspergillus oryzae 3.042] 506 aa protein EIT82651.1 GI:391873626

SEQ ID NO: 688 - protein, 998 aa, Artificial Sequence
  lactase B [Aspergillus kawachii IFO 4308] 998 aa protein GAA82087.1 GI:358365465
MTRITKLCALLLSSTGLLAAAQNQTETGWPLYDDGLTTDIQWDHYSFKVHVPGLWRDILEKIKAAGFTTFSIYSSWAWHAPNNHTVDFSTGARDITPIFELAKELGMYIIVRPGPYINAEASAGGFPLWLTTGDYGTLRNNDSRYTAAWKPYFEKMTEITSRYQVTNGHNTFCYQIENEYGDQWLSDPSERVPNETAIAYMELLESSARENGILVPFTANDPNMNAMAWSRDWSNAGGNVDVVGLDSYPSCWTCDVSQCTSTNGEYVAYQVVEYYDYFLEFSPTMPSFMPEFQGGSYNPWAGPEGGCGDDTGVDFVNLFYRWNIAQRVTAMSLYMLYGGTNWGAIAAPVTATSYDYSSPISEDRSISSKYYETKLLSLFTRSARDLTMTDLIGNGTQYTNNTAVKAYELRNPTTNAGFYVTLHEDSTVGTNEAFSLRVNTSAGNLIVPRLGGSIRLNGHQSKIIVTDFTFGSETLLYSTAEVLTYAVLDKKPTLVLWVPTGESGEFAVKGAKSGSVVSKCQDCSAINFHQQGGNLVVGFTQAQGMSIVQIDNDIRVILLDRTAAYEFWAPALTEDPLVPEDEAVLIQGPYLVRSASLEKSTLAIKGDSINETAVEIFAPNDVKTVTWNGKQLKTSKSSYGSLKATIAAPVSIQLPAFTSWKVNDSLPERLPTYDASGLAWVDANHMTTANPSKPATLPVLYADEYGFHNGVRLWRGYFNGTASGVFLNVQGGSAFGFSAYLNGQFLGSYLGNASIEQANQTFVFPTNITHPTTQNTLLIIHDDTGHDETTGALNPRGILEARLLPSTTTDNTASPEFTHWRLAGTAGGESNLDPVRGAWNEDGLYAERVGWHLPGFDDSTWPSVSSSSLSFTGATVKFFRTTIPLNIPRGLDVSISFVLGTPDNAPNTYRAQLFVNGYQYGRFNPYIGNQVVFPVPVGVLDYSGENTIGVAVWAQTEDGAAITVDWKVNYVADSSLDVAGLETAGLRPGWSVERLKFA

SEQ ID NO: 689 - protein, 985 aa, Artificial Sequence
  RecName: Full=Probable beta-galactosidase C; AltName: Full=Lactase C; Flags: Precursor 985 aa protein A1CE56.1 GI:00680864
MRILSLLFLLLLGFLAGNRVVSATDHGKTTDVTWDRYSLSVKGERLFVFSGEFHYQRLPVPEMWLDVFQKLRANGFNAISVYFFWGYHSASEGEFDFETGAHNIQRLFDYAKEAGIYVIARAGPYCNAETTAGGYALWAANGQMGNERTSDDAYYAKWRPWILEVGKIIAANQITNGGPVILNQHENELQETSYEADNTLVVYMKQIARVFQEAGIVVPSSHNEKGMRAVSWSTDHHDVGGAVNIYGLDSYPGGLSCTNPSSGFNLVRTYYQWFQNSSYTQPEYLPEFEGGWFQPWGGHDYDTCATELSPEFADVYYKNNIGSRVTLQNIYMVFGGTNWGHSAAPVVYTSYDYSAPLRETREIRDKLKQTKLIGLFTRVSSDLLKTHMEGNGTGYTSDSSIYTWALHNPDTNAGFYVLAHKTSSSRSVTEFSLNVTTSAGAISIPDIQLDGRQSKIIVTDYQFGKSSALLYSSAEVLTYANLDVDVLVLYLNVGQKGLFVFKDERSKLSFQTYGNTNVTASVSSHGTQYIYTQAEGVTAVKFSNGVLAYLLDKESAWNFFAPPTTSNPQVAPDEHILVQGPYLVRGVTINHDTVEIIGDNANTTSLEVYAGNLRVKVVKWNGKAIKSRRTAYGSLVGRAPGAEDARISPPSLDSWSAQDTLPDIQPDYDDSRWTVCNKTASVNAVPLLSLPVLYSGDYGYHAGTKVYRGRFDGRNVTGANVTVQNGVASGWAAWLNGQFVGGVAGAIDLAVTSAVLSFNSSLLHDRDNVLTVVTDYTGHDQNSVRPKGTQNPRGILGATLIGGGKFTSWRIQGNAGGEKNIDPVRGPINEGGLYGERMGWHLPGYKAPRSAAKSSPLDGISGAEGRFYTTTFTLKLDRDLDVPIGLQLGAPAGTQAVVQVFMNGYQFGHYLPHIGPQSLFPFPPGVINNRGENTLAISMWALTDAGAKLDQVELVAYGKYRSGFDFNQDWGYLQPQWKDNRRQYA

SEQ ID NO: 690 - protein, 1015 aa, Artificial Sequence
  RecName: Full=Probable beta-galactosidase B; AltName: Full=Lactase B; Flags: Precursor 1015 aa protein A1D199.1 GI:00680896
MAHIYRLLLLLLSNLWFSAAAQNQSETEWPLHDNGLSKVVQWDHYSFQVNGQRIFIFSGEFHYWRIPVPELWRDILEKVKATGFTAFAFYSSWAYHAPNNRTVDFSTGARDITPIFELAKELGMYMIVRPGPYVNAEASAGGFPLWLTTGEYGSLRNDDPRYTAAWTPYFANMSQITSKYQVTDGHNTLVYQIENEYGQQWIGDPKDRNPNKTAVAYMELLEASALENGITVPLTSNDPNMNSKSWGSDWSNAGGNVDVAGLDSYPSCWTCDVSQCTSTNGEYVPYKVIDYYDYFQEVQPTLPSFMPEFQGGSYNPWAGPEGGCPQDTGAEFANLFYRWNIGQRVTAMSLYMLYGGTNWGAIAAPVTATSYDYSAPISEDRSIGAKYSETKLLALFTRTAKDLTMTEAIGNGTQYTTNTAVRAFELRNPQTNAGFYVTFHNDTTVGGNQAFKLHVNTSVGALTVPKNEGVIQLNGHQSKIIVTDFTLGKRTLLYSTAEVLTYAVFENRPTLVLWVPTGESGEFAIKGTKSGKVENGDGCSGINFKREKDYLVVNFSQAKGLSVLRLDNGVRVVLLDKAAAYRFWAPALTDDPIVQETETVLVHGPYLVRSASVSKSTLALRGDSVEKTTLEIFAPHSVRKITWNGKEVKTSQTPYGSLKATLAAPPTIKLPALTSWRSNDSLPERLPSYDDSGPAWIEANHMTTSNPSPPATLPVLYADEYGFHNGVRLWRGYFNGSASGVFLNIQGGSAFGWSAWLNGHFLDSHLGTATTSQANKTLTFSSSILNPTENVLLIVHDDTGHDQTTGALNPRGIIEARLLSNDTSSPAPGFTQWRIAGTAGGESNLDPIRGVFNEDGLFAERMGWHLPGFDDSAWTPENSTTSASSALSFTGATVRFFRTVVPLDIPAGLDVSISFVLSTPSAAPKGYRAQLFVNGYQYGRYNPHIGNQVVFPVPPGILDYQGDNTIGLAVWAQTEEGAGIQVDWKVNYVADSSLSVAGFGKGLRPGWTEERLKFA

SEQ ID NO: 691 - protein, 1006 aa, Artificial Sequence
  RecName: Full=Probable beta-galactosidase A; AltName: Full=Lactase A; Flags: Precursor 1006 aa protein A1D1Z9.1 GI:300680858
MKLLSVCAVALLAAQAAGASIKHKLNGFTIMEHSDPAKRELLQKYVTWDEKSLFVNGERIMIFSGEVHPFRLPVPSLWLDVFQKIKALGFNCVSFYVDWALLEGKPGKYRAEGNFALEPFFDAAKQAGIYLLARPGPYINAEASGGGFPGWLQRVNGTLRTSDPAYLKATDNYIAHVAATVAKGQITNGGPVILYQPENEYSGACCNATFPDGDYMQYVIDQARNAGIVVPLINNDAWTGGHNAPGTGKGEVDIYGHDSYPLGFDCGHPSVWPKGNLPTTFRTDHLRESPTTPYSLIEFQAGSFDPWGGPGFAACAALVNHEFERVFYKNDLSFGAAILNLYMTFGGTNWGNLGHPGGYTSYDYGSPLTESRNVTREKYSELKLIGNFVKASPSYLLATPGNLTTSGYADTADLTVTPLLGNGTGSYFVVRHTDYTSQASTPYKLSLPTSAGRLTVPQLGGTLTLNGRDSKVHVVDYNVAGTNILYSTAEVFTWKKFGDSKVLVLYGGPGEHHELAVSLKSDVQVVEGSNSEFTSKKVEDVVVVAWDVSASRRIVQIGDLKIFLLDRNSAYNYWVPQLDKDDSSTGYSSEKTTASSIIVKAGYLVRTAYTKGSGLYLTADFNATTPVEVIGAPSNVRNLYINGEKTQFKTDKNGIWSTGVKYSAPKIKLPSMKDLDWKYLDTLPEVQSTYDDSAWPAADLDTTPNTLRPLTMPKSLHSSDYGFHTGYLIYRGHFVADGSETTFDVRTQGGSAFGSSVWLNEAFLGSWTGLNANADYNSTYRLPQVEKGKNYVLTVVIDTMGLNENWVVGTDEMKNPRGILSYKLSGRDASAITWKLTGNLGGEDYQDKIRGPLNEGGLYAERQGFHQPEPPSKKWKSASPLDGLSKPGIGFYTAQFDLDIPSGWDVPLYFNFGNSTKSAYRVQLYVNGYQYGKFVSNIGPQTSFPVPQGILNYQGTNWVALTLWALESDGAKLDDFELVNTTPVMTALSKIRPSKQPNYRQRKGAY

SEQ ID NO: 692 - protein, 1011 aa, Artificial Sequence
  RecName: Full=Probable beta-galactosidase E; AltName: Full=Lactase E; Flags: Precursor 1011 aa protein A1DJ58.1 GI: 300680873
MKFLLRRFIALAAASSVVAAPSVSHLSLQDAANRRELLQDLVTWDQHSLFVRGERLMIFSGEFHPFRLPVPGLWFDVFQKITSLGFNAVSFYTDWGLMEGNPGHVVTDGIWSLDEFFTAASEAGIYLIARPGPYINAETSAGGIPGWVLRLKGIIRSNSEDYLRATDTYMATLGKIIAKAQITNGGPVILVQPENEYTTWPNVSESEFPTTMNKEVMAYAEKQLRDAGVVVPTVVNDNKNLGYFAPGTGLGETDLYGIDAYPMRYDCGNPYVWPTYRFPRDWQHTHRNHSPTTPFAIMEFQGGSGDGWGGVTEDGCAILVNNEAVRVVYKNNYGFGVGVFNIYMTYGGTNWGNLGYHGGYTSYDYGAAITEDRQIWREKYSEEKLQANFLKVSPAYLTATPGNGVNGSYTGNKDIAVTPLFGNGTTTNFYLVRHADFTSTGSVQYQLSVSTSVGNVTIPQLGGSLSLNGRDSKFHVTDYDVGEFNLIYSSAEIFTWAKGDNKKRVLVLYGGAGELHEFALPKHLPRPTVVDGSDVKMAKKGSAWVVQWEVTAQRRVLRAGKLEIHLLWRNDAYQHWVLELPAKQPIANYSSPSKETVLVKGGYLLRSACITNNKLHLTGDVNATTPLEVISAPKRFDGIVFNGQSLKSTRSKIGNLAATVRYQPPAISLPDLKRLDWKYLDSLPEISPDYSDEGWMSLTNTYTNNTRKFTGPTCLYADDYGYHGGSLIYRGHFKANGDESWVFLNTSGGVGFANSVWLNQTFLGSWTGSGNNMTYPRNISLPHELSPGKPYVFTVVIDHMGQDEEAPGTDAIKFPRGILDYALSGHEVSDLKWKMTGNLGGEQYQDSTRGPLNEGAMYAERRGYHLPNPPTSSWKSSSPINDGLTGAGIGFYATSFSLDLPEGYDIPLSFLFNNSASDARSGTSYRCQLFVNGYQFGKYVNDLGPQTNFPVPEGILNYNGVNYVAVSLWALEPQGALVGGLELVASTPILSAYRKPVPAPQPGWKPRRGAY

SEQ ID NO: 693 - protein, 983 aa, Artificial Sequence
  RecName: Full=Probable beta-galactosidase C; AltName: Full=Lactase C; Flags: Precursor 983 aa protein A1DM65.1 GI: 300680868
MRIFSFLFLLLLGILTGQGLVSGTDNGKTTDVTWDKYSLSVKGQRLFVFSGEFHYQRLPVPELWLDVFQKLRANGFNAISVYFFWSFHSASEGEFDFENGAHDIQRLFDYAKEAGLYVIARAGPYCNAETSAGGFALWAANGQMGNERTSDEAYYEKWRPWILEVGKIIAKNQITNGGPVILNQHENELTETTYDPNHTLVVYMKQIAQVFEEAGIVVPSSHNEKGMRGVSWSTDYHNVGGAVNIYGLDSYPGGLSCTNPNSGFRLVRTYYQWFQNYSSTQPSYMPEFEGGWFQPWGGSFYDTCATELSPEFPDVYYKNNIGSRVTLHSIYMTYGGTNWGHSAAPVVYTSYDYAAPLRETREIRDKLKQTKLIGLFTRVSTDLLKTYMEGNGTGYTSDSSIYTWSLRNPDTNAGFYVLAHSTSSARDVTTFSLNATTSAGAISIPDIELNGRQSKIIVTDYNFGTNSTLLFSSAEVLTYANLDVNVLVFYLNVGQKGTFALKDEPKLAFQTYGNSNVTTSESSYGTQYSYTQGEGVTAVKFSNGVLAYLLDKESAWNFFAPPTTSSPQVAPNEHILVQGPYLVRGASINHGTVEITGDNANTTSIEVYTGNSQVKKVKWNGKTIETRKTAYGSLIGTVPGAEDVKIRLPSLDSWKAQDTLPEIQPDYDDSTWTVCNKTTSVNAIAPLSLPVLYSGDYGYHAGTKVYRGRFDGRNVTGANVTVQNGAAAGWAAWVNGQYAGGSAGSPSLAATSAVLTFNGLSLKDRDNVLTVVTDYTGHDQNSVRPKGTQNPRGILGATLTGGGNFTSWRIQGNAGGEKNIDPVRGPMNEGGLYGERMGWHLPGYKVPKSASKSSPLDGVSGAEGRFYTTTFKLKLDKDLDVPIGLQLGAPEGTKAVVQVFMNGYQFGHYLPHTGPQSLFPFPPGVINNRGENTLAISMWALTDAGAKLDKVELVAYGKYRSGFDFNQDWGYLQPGWKDRSQYA

SEQ ID NO: 694 - protein, 1017 aa, Artificial Sequence
  RecName: Full=Probable beta-galactosidase B; AltName: Full=Lactase B; Flags: Precursor 1017 aa protein A2QA64.2 GI: 300681011
MTRITKLCVLLLSSIGLLAAAQNQTETGWPLHDDGLTTDVQWDHYSFKVHGERIFVFSGEFHYWRIPVPGLWRDILEKIKAAGFTTFAFYSSWAWHAPNNHTVDFSTGARDITPIFELAKELGMYIIVRPGPYINAEASAGGFPLWLTTGDYGTLRNNDSRYTEAWKPYFEKMTEITSRYQITNGHNTFCYQIENEYGDQWLSDPSERVPNETAIAYMELLESSARENGILVPFTANDPNMNAMAWSRDWSNAGGNVDVVGLDSYPSCWTCDVSQCTSTNGEYVAYQVVEYYDYFLDFSPTMPSFMPEFQGGSYNPWAGPEGGCGDDTGVDFVNLFYRWNIAQRVTAMSLYMLYGGTNWGAIAAPVTATSYDYSSPISEDRSISSKYYETKLLSLFTRSARDLTMTDLIGNGTQYTNNTAVKAYELRNPTTNAGFYVTLHEDSTVGTNEAFSLRVNTSAGNLIVPRLGGSIRLNGHQSKIIVTDFTFGSETLLYSTAEVLTYAVIDKKPTLVLWVPTDESGEFAVKGAKSGSVVSKCQSCPAINFHQQGGNLIVGFTQSQGMSVVQIDNDIRVVLLDRTAAYKFWAPALTEDPLVPEDEAVVLIQGPYLVRSASLEKSTLAIKGDSINETAVEIFAPENVKTITWNGKQLKTSKSSYGSLKATIAAPASIQLPAFTSWKVNDSLPERLPTYDASGPAWVDANHMTTANPSKPATLPVLYADEYGFHNGVRLWRGYFNGTASGVFLNVQGGSAFGFSAYLNGHFLGSYLGNASIEQANQTFLFPNNITHPTTQNTLLVIHDDTGHDETTGALNPRGILEARLLPSDTTNNSTSPEFTHWRIAGTAGGESNLDPVRGAWNEDGLYAERVGWHLPGFDDSTWSSVSSSSSLSFTGATVKFFRTTIPLDIPRGLDVSISFVLGTPDNAPNAYRAQLFVNGYQYGRFNPYIGNQVVFPVPVGVLDYTGENTIGVAVWAQTEDGAGITVDWKVNYVADSSLDVSGLETGELRPGWSAERLKFA

SEQ ID NO: 695 - protein, 1007 aa, Artificial Sequence
  RecName: Full=Probable beta-galactosidase A; AltName: Full=Lactase A; Flags: Precursor 1007 aa protein A2QAN3.1 GI: 300680857
MKLSSACAIALLAAQAAGASIKHRINGFTLTEHSDPAKRELLQKYVTWDDKSLFINGERIMIFSGEFHPFRLPVKELQLDIFQKVKALGFNCVSFYVDWALVEGKPGEYRADGIFDLEPFFDAASEAGIYLLARPGPYINAESSGGGFPGWLQRVNGTLRSSDKAYLDATDNYVSHVAATIAKYQITNGGPIILYQPENEYTSGCCGVEFPDPVYMQYVEDQARNAGVVIPLINNDASASGNNAPGTGKGAVDIYGHDSYPLGFDCANPTVWPSGDLPTNFRTLHLEQSPTTPYAIVEFQGGSYDPWGGPGFAACSELLNNEFERVFYKNDFSFQIAIMNLYMIFGGTNWGNLGYPNGYTSYDYGSAVTESRNITREKYSELKLLGNFAKVSPGYLTASPGNLTTSGYADTTDLTVTPLLGNSTGSFFVVRHSDYSSEESTSYKLRLPTSAGSVTIPQLGGTLTLNGRDSKIHVTDYNVSGTNIIYSTAEVFTWKKFADGKVLVLYGGAGEHHELAISTKSNVTVIEGSESGISSKQTSSSVVVGWDVSTTRRIIQVGDLKILLLDRNSAYNYWVPQLATDGTSPGFSTPEKVASSIIVKAGYLVRTAYLKGSGLYLTADFNATTSVEVIGVPSTAKNLFINGDKTSHTVDKNGIWSATVDYNAPDISLPSLKDLDWKYVDTLPEIQSSYDDSLWPAADLKQTKNTLRSLTTPTSLYSSDYGFHTGYLLYRGHFTATGNESTFAIDTQGGSAFGSSVWLNGTYLGSWTGLYANSDYNATYNLPQLQAGKTYVITVVIDNMGLEENWTVGEDLMKTPRGILNFLLAGRPSSAISWKLTGNLGGEDYEDKVRGPLNEGGLYAERQGFHQPEPPSQNWKSSSPLEGLSEAGIGFYSASFDLDLPKGWDVPLFLNIGNSTTPSPYRVQVYVNGYQYAKYISNIGPQTSFPVPEGILNYRGTNWLAVTLWALDSAGGKLESLELSYTTPVLTALGEVESVDQPKYKKRKGAY

SEQ ID NO: 696 - protein, 994 aa, Artificial Sequence
  RecName: Full=Probable beta-galactosidase C; AltName: Full=Lactase C; Flags: Precursor 994 aa protein A2QL84.1 GI: 300680867
MKLQSILSCWAILVAQIWATTDGLTDLVAWDPYSLTVNGNRLFVYSGEFHYPRLPVPEMWLDVFQKMRAHGFNAVSLYFFWDYHSPINGTYDFETGAHNIQRLFDYAQEAGIYIIARAGPYCNAEFNGGGLALYLSDGSGGELRTSDATYHQAWTPWIERIGKIIADNSITNGGPVILNQIENELQETTHSASNTLVEYMEQIEEAFRAAGVDVPFTSNEKGQRSRSWSTDYEDVGGAVNVYGLDSYPGGLSCTNPSTGFSVLRNYYQWFQNTSYTQPEYLPEFEGGWFSAWGADSFYDQCTSELSPQFADVYYKNNIGQRVTLQNLYMLYGGTNWGHLAAPVVYTSYDYSAPLRETRQIRDKLSQTKLVGLFTRVSSGLLGVEMEGNGTSYTSTTSAYTWVLRNPNTTAGFYVVQQDTTSSQTDITFSLNVNTSAGAFTLPNINLQGRQSKVISTDYPLGHSTLLYVSTDIATYGTFGDTDVVVLYARSGQVVSFAFKNTTKLTFEEYGDSVNLTSSSGNRTITSYTYTQGSGTSVVKFSNGAIFYLVETETAFRFWAPPTTTDPYVTAEQQIFVLGPYLVRNVSISGSVVDLVGDNDNATTVEVFAGSPAKAVKWNGKEITVTKTDYGSLVGSIGGADSSSITIPSLTGWKVRDSLPEIQSSYDDSKWTVCNKTTTLSPVDPLSLPVLFASDYGYYTGIKIYRGRFDGTNVTGANLTAQGGLAFGWNVWLNGDLVASLPGDADETSSNAAIDFSNHTLKQTDNLLTVVIDYTGHDETSTGDGVENPRGLLGATLNGGSFTSWKIQGNAGGAAGAYELDPVRAPMNEGGLLAERQGWHLPGYKAKSSDGWTDGSPLDGLNKSGVAFYLTTFTLDLPKKYDVPLGIQFTSPSTVDPVRIQLFINGYQYGKYVPYLGPQTTFPIPPGIINNRDKNTIGLSLWAQTDAGAKLENIELISYGAYESGFDAGNGTGFDLNGAKLGYQPEWTEARAKYT

SEQ ID NO: 697 - protein, 1006 aa, Artificial Sequence
  RecName: Full=Probable beta-galactosidase A; AltName: Full=Lactase A; Flags: Precursor 1006 aa protein BXMP7.2 GI: 300681017
MKLLSVCAIALLAAQAAGASIKHMLNGFTLMEHSDPAKRELLQKYVTWDEKSLFVNGERIMIFSGEVHPFRLPVPSLWLDVFQKIKALGFNCVSFYVDWALLEGKPGEYRAEGNFALEPFFDVAKQAGIYLLARPGPYINAEASGGGFPGWLQRVNGTLRTSDPAYLKATDNYIAHVAATIAKGQITNGGPVILYQPENEYSGACCDATFPDGDYMQYVIDQARNAGIVVPLINNDAWTGGHNAPGTGKGEVDIYGHDSYPLGFDCGHPSVWPKGNLPTTFRTDHLKQSPTTPYSLIEFQAGSFDPWGGPGFAACAALVNHEFERVFYKNDLSFGAAILNLYMTFGGTNWGNLGHPGGYTSYDYGSPLTESRNVTREKYSELKLIGNFVKASPSYLLATPGNLTTSGYADTADLTVTPLLGNGTGSYFVVRHTDYTSQASTPYKLSLPTSAGRLTVPQLGGTLTLNGRDSKIHVVDYNVAGTNIIYSTAEVFTWKNFGDSKVLILYGGPGEHHELAVSFKSDVQVVEGSNSEFKSKKVGDVAVVAWDVSPSRRIVQIGDLKIFLLDRNSVYNYWVPQLDKDDSSTGYSSEKTTASSIIVKAGYLVRTAYTKGSGLYLTADFNATTPVEVIGAPSNVRNLYINGEKTQFKTDKNGIWSTEVKYSAPKIKLPSMKDLDWKYLDTLQEVQSTYDDSAWPAADLDTTPNTLRPLTTPKSLYSSDYGFHTGYLIYRGHFVADGSETTFDVRTQGGSAFGSSVWLNESFLGSWTGLNANADYNSTYKLPQVEQGKNYVLTILIDTMGLNENWVVGTDEMKNPRGILSYKLSGRDASAITWKLTGNLGGEDYQDKIRGPLNEGGLYAERQGFHQPQPPSQKWKSASPLDGLSKPGIGFYTAQFDLDIPSGWDVPLYFNFGNSTKSAYRVQLYVNGYQYGKFVSNIGPQTSFPVPQGILNYQGTNWVALTLWALESDGAKLDDFELVNTTPVMTALSKIRPSKQPNYRQRKGAY

SEQ ID NO: 698 - protein, 1015 aa, Artificial Sequence
  RecName: Full=Probable beta-galactosidase B; AltName: Full=Lactase B; Flags: Precursor 1015 aa protein B0XNY2.1 GI: 300680860
MAHIYRLLLLLLSNLWFSTAAQNQSETEWPLHDNGLSKVVQWDHYSFQVNGQRIFIFSGEFHYWRIPVPELWRDILEKVKATGFTAFAFYSSWAYHAPNNSTVDFSTGARDITPIFELAKELGMYMIVRPGPYVNAEASAGGFPLWLMTGEYGSLRNDDPRYTAAWTPYFANMSQITSKYQVTDGHNTLVYQIENEYGQQWIGDPKNRNPNKTAVAYMELLEASARENGITVPLTSNDPNMNSKSWGSDWSNAGGNVDVAGLDSYPSCWTCDVSQCTSTNGEYVPYKVIDYYDYFQEVQPTLPSFMPEFQGGSYNPWAGPEGGCPQDTSAEFANLFYRWNIGQRVTAMSLYMLYGGTNWGAIAAPVTATSYDYSAPISEDRSIGAKYSETKLLALFTRTAKDLTMTEAIGNGTQYTTNTAVRAFELRNPQTNAGFYVTFHTDTTVGGNQAFKLHVNTSVGALTVPKNEGLIQLNGHQSKIIVTDFTLGKRTLLYSTAEVLTYAVFENRPTLVLWVPTGESGEFAIKGAKSGKVENGDGCSGIKFKREKDYLVVNFSQAKGLSVLRLDNGVRVVLLDKAAAYRFWAPALTDDPNVQETETVLVHGPYLVRSASISKTTLALRGDSVEKTTLEIFAPHSVRKITWNGKEVQTSHTPYGSLKATLAAPPDIKLPALTSWRSNDSLPERLPSYDDSGPAWIEANHMTTSNPSPPATFPVLYADEYGFHNGVRLWRGYFNGSASGVFLNIQGGSAFGWSAWLNGHFLDSHLGTATTSQANKTLTFPSSILNPTENVLLIVHDDTGHDQTTGALNPRGILEARLLSNDTSSPPPEFTHWRLAGTAGGESNLDPIRGVFNEDGLFAERMGWHLPGFDDSAWTSENSATSASSALSFTGATVRFFRSVVPLNIPAGLDVSISFVLSTPTAAPKGYRAQLFVNGYQYGRYNPHIGNQVVFPVPPGILDYQGDNTIGLAVWAQTEEGAGIQVDWKVNYVADSSLSVAGFGKGLRPGWTEERLKFA

SEQ ID NO: 699 - protein, 1011 aa, Artificial Sequence
  RecName: Full=Probable beta-galactosidase E; AltName: Full=Lactase E; Flags: Precursor 1011 aa protein B0XXE7.1 GI:300680872
MKSLLKRLIALAAAYSVAAAPSFSHHSSQDAANKRELLQDLVTWDQHSLFVRGERLMIFSGEFHPFRLPVPGLWFDVFQKIKSLGFNAVSFYTDWGLMEGNPGHVVTDGIWSLDEFFTAAREAGLYLIARPGPYINAETSAGGIPGWVLRRKGIIRSNSEDYLRATDTYMATLGKIIAKAQITNGGPVILVQPENEYTTWPNVSESEFPTTMNQEVMAYAEKQLRDAGVVVPTVVNDNKNLGYFAPGTGLGETDLYGIDAYPMRYDCGNPYVWPTYRFPRDWQHEHRNHSPTTPFAIMEFQGGSGDGWGGVTEDGCAILVNNEAVRVVYKNNYGFGVRVFNIYMTYGGTNWGNLGYYGGYTSYDYGAAITEDRQIWREKYSEEKLQANFLKVSPAYLTSTPGNGVNGSYTGNKDITVTPLFGNGTTTNLYLVRHADFTSTGSAQYNLSISTSVGNVTIPQLGGSLSLNGRDSKFHITDYDVGGFNLIYSSAEVFTWAKGDNKKRVLVLYGGAGELHEFALPKHLPRPTVVEGSYVKIAKQGSAWVVQWEVAAQRRVLRAGKLEIHLLWRNDAYQHWVLELPAKQPIANYSSPSKETVIVKGGYLLRSAWITDNDLHLTGDVNVTTPLEVISAPKRFDGIVFNGQSLKSTRSKIGNLAATVHYQPPAISLPDLKRLDWKYIDSLPEISTEYNDEGWTPLTNTYTNNTREFTGPTCLYADDYGYHGGSLIYRGHFTANGDESWVFLNTSGGVGFANSVWLNQTFLGSWTGSGRNMTYPRNISLPHELSPGEPYVFTVVIDHMGQDEEAPGTDAIKFPRGILDYALSGHELSDLRWKMTGNLGGEQYQDLTRGPLNEGAMYAERQGYHLPSPPTSSWKSSNPIKEGLTGAGIGFYATSFSLDLPEGYDIPLSFRFNNSASAARSGTSYRCQLFVNGYQFGKYVNDLGPQTKFPVPEGILNYNGVNYVAVSLWALESQGALIGGLDLVASTPILSGYRKPAPAPQPGWKPRRGAY

SEQ ID NO: 700 - protein, 983 aa, Artificial Sequence
  RecName: Full=Probable beta-galactosidase C; AltName: Full=Lactase C; Flags: Precursor 983 aa protein B0Y752.1 GI:300680865
MRIFSFLFLLLLGILTGQGLVSGTDNGKTTDVTWDKYSLSVKGQRLFVFSGEFHYQRLPVPELWLDVFQKLRANGFNAISVYFFWSFHSASEGEFDFENGAHDIQRLFDYAKEAGLYVIARAGPYCNAETSAGGFALWAANGQMGNERTSDEAYYEKWRPWILEVGKIIAKNQITNGGPVILNQHENELVETTYDPNHTLVVYMKQIAQVFEEAGIVVPSSHNEKGMRGVSWSTDYHNVGGAVNIYGLDSYPGGLSCTNPNSGFNLVRTYHQWFQNYSFTQPSYLPEFEGGWFQPWGGSFYDTCATELSPEFPDVYYKNNIGSRVTLHSIYMTYGGTNWGHSAAPVVYTSYDYAAPLRETREIRDKLKQTKLIGLFTRVSKDLLKTYMEGNGTGYTSDSSIYTWSLRNPDTNAGFYVLAHSTSSTRDVTTFTLNVTTSAGAISIPDIELNGRQSKIIVTDYNFGTNSTLLFSSAEVLTYANLDVNVLVFYLNVGQKGTFVFKDEPKLAFQTYGNSNLTTSESSYGTQYSYTQGKGVTAVKFSNGVLAYFLDKESAWNFFAPPTTSSPQVAPNEHILVQGPYLVRGASVNHGTVEITGDNANTTSIEVYTGNSQVKKIKWNGKTIETRKTAYGSLIGTAPGAEDVKIQLPSLDSWKAQDTLPEIQPDYDDSKWTVCNKTTSVNAIAPLSLPVLYSGDYGYHAGTKVYRGRFDGRNVTGANVTVQNGAAAGWAAWVNGQYAGGSAGSPNLAATSAVLTFNSSSLKDQDNVLTVVTDYTGHDQNSVRPKGTQNPRGILGATLIGGGNFTSWRIQGNAGGEKNIDPVRGPMNEGGLYGERMGWHLPGYKVPKSASKSSPLDGVSGAEGRFYTTTFKLKLDKDLDVPIGLQLGAPEGTKAVVQVFMNGYQFGHYLPHTGPQSLFPFPPGVINNRGENTLAISMWALTDAGAKLDKVELVAYGKYRSGFDFNQDWGYLQPGWKDRSQYA

SEQ ID NO: 701 - protein, 984 aa, Artificial Sequence
  RecName: Full=Probable beta-galactosidase C; AltName: Full=Lactase C; Flags: Precursor 984 aa protein B8N2I5.1 GI:300680866
MRLLSFIYLVWLALLTGTPQVSATDNGKTSDVAWDKYSLSVKGERLFVFSGEFHYQRLPVPELWLDVFQKLRANGFNTISVYFFWSYHSASEDVFDFTTGAHDIQRLFDYAKQAGLYVIARAGPYCNAETSAGGFALWAANGQMGSERTSDEAYYKKWKPWILEVGKIIAANQITNGGPVILNQHENELQETTYDSNDTKVIYMEQVAKAFEEAGVVVPSSHNEKGMRTVSWSTDYKNVGGAVNVYGLDSYPGSLSCANPNSGFNLLRTYYQWFQNYSYTQPEYLAEFEGGWFQPWGGSFYDSCASELSPEFADVYYKNNIGSRVTLHNIYMTFGGTNWGHSAAPVVYTSYDYGSPLRETREIRDKLKQTKLLGLFTRVSKDLLKTYMEGNGTSYTSDDSIYTWALRNPDSDAGFYVVAHNTSSSREVTTFSLNITTSAGALTIPDIELDGRQSKIIVTDYSIGSESSLLYSSAEVLTYATLDVDVLVFYLNAGQKGAFVFKDAPADLKYQTYGNSNLSALETSQGTQYSYTQGEGVTAVKFSNGVLVYLLDKETAWNFFAPPTVSSPTVAPNEHILVFGPYLVRGASIKHDTVEIVGDNSNSTSIEIYTGDEHVKKVSWNGNLIDTRATAYGSLIGTVPGAEDIEISLPSLSSWKAQDTLPEISPDYDDSRWTICNKTTSVNSVAPLSLPVLYSGDYGYHTGTKIYRGRFDGQNATGANVTVQNGVAAGWAAWLNGAYVGGFSGDPDKVASWEVLKFNHSSLRSRDNVLTIITDYTGHDQNSQKPIGTQNPRGIMGATLIGGGNFTLWRIQGNAGGEKNIDPVRGPMNEGGLYGERMGWHLPGYQVPESALDSSPLEGVSGAEGRFYTTSFQLDLEEDLDVPIGLQLSAPAGTEAVVQIFMNGYQFGHYLPHIGPQSLFPFPPGVIYNRGQNSLAISMWALTDAGARLEQVELKAYAKYRSGFDFNRDWTYLQPGWKDRTEYA

SEQ ID NO: 702 - protein, 1005 aa, Artificial Sequence
  RecName: Full=Probable beta-galactosidase A; AltName: Full=Lactase A; Flags: Precursor 1005 aa protein B8N6V7.1 GI:300680889
MKLLSVAAVALLAAQAAGASIKHRLNGFTILEHPDPAKRDLLQDIVTWDDKSLFINGERIMLFSGEVHPFRLPVPSLWLDIFHKIRALGFNCVSFYIDWALLEGKPGDYRAEGIFALEPFFDAAKEAGIYLIARPGSYINAEVSGGGFPGWLQRVNGTLRSSDEPFLKATDNYIANAAAAVAKAQITNGGPVILYQPENEYSGGCCGVKYPDADYMQYVMDQARKADIVVPFISNDASPSGHNAPGSGTGAVDIYGHDSYPLGFDCANPSVWPEGKLPDNFRTLHLEQSPSTPYSLLEFQAGAFDPWGGPGFEKCYALVNHEFSRVFYRNDLSFGVSTFNLYMTFGGTNWGNLGHPGGYTSYDYGSPITETRNVTREKYSDIKLLANFVKASPSYLTATPRNLTTGVYTDTSDLAVTPLIGDSPGSFFVVRHTDYSSQESTSYKLKLPTSAGNLTIPQLEGTLSLNGRDSKIHVVDYNVSGTNIIYSTAEVFTWKKFDGNKVLVLYGGPKEHHELAIASKSNVTIIEGSDSGIVSTRKGSSVIIGWDVSSTRRIVQVGDLRVFLLDRNSAYNYWVPELPTEGTSPGFSTSKTTASSIIVKAGYLLRGAHLDGADLHLTADFNATTPIEVIGAPTGAKNLFVNGEKASHTVDKNGIWSSEVKYAAPEIKLPGLKDLDWKYLDTLPEIKSSYDDSAWVSADLPKTKNTHRPLDTPTSLYSSDYGFHTGYLIYRGHFVANGKESEFFIRTQGGSAFGSSVWLNETYLGSWTGADYAMDGNSTYKLSQLESGKNYVITVVIDNLGLDENWTVGEETMKNPRGILSYKLSGQDASAITWKLTGNLGGEDYQDKVRGPLNEGGLYAERQGFHQPQPPSESWESGSPLEGLSKPGIGFYTAQFDLDLPKGWDVPLYFNFGNNTQAARAQLYVNGYQYGKFTGNVGPQTSFPVPEGILNYRGTNYVALSLWALESDGAKLGSFELSYTTPVLTGYGNVESPEQPKYEQRKGAY

SEQ ID NO: 703 - protein, 1020 aa, Artificial Sequence
  RecName: Full=Probable beta-galactosidase B; AltName: Full=Lactase B; Flags: Precursor 12 aa protein B8NKI4.2 GI:68115
MLISKTVLSGLALGASFVGVSAQQNSTRWPLHDNGLTDTVEWDHYSFLINGQRHFVFSGEFHYWRIPVPELWRDLLEKIKAAGFTAFSIYNHWGYHSPKPGVLDFENGAHNFTSIMTLAKEIGLYMIIRPGPYVNAEANAGGLPLWTTTGAYGKLRDNDPRYLEALTPYWANISKIIAPHLITNGGNVILYQIENEYAEQWLDEETHEPNTSGQEYMQYLEDVARENGIDAPLIHNLPNMNGHSWSKDLSNATGNVDVIGVDSYPTCWTCNVSECASTNGEYIPYKTLIYYDYFKELSPTQPSFMPEFQGGSYNPWGGPQGGCPDDLGPDFANLFYRNLISQRVSAISLYMLYGGTNWGWHASTDVATSYDYSSPISENRKLIEKYYETKVLTQFTKIAQDLSKVDRLGNSTKYSSNPAVSVAELRNPDTGAAFYVTQHEYTPSGTVEKFTVKVNTSEGALTIPQYGSQITLNGHQSKIIVTDFKFGSKTLLYSTAEVLTYAVIDGKEVLALWVPTGESGEFTVKGVNSAKFADKGRTANIEIHPGANNVTVSFMQRSGMSLVELGDGTRIVLLDRSAAHVFWSTPLNNDPAEAGNNTVLVHGPYLVRSAKLEGCDLKLTGDIQNSTEVSIFAPKSVCSVNWNGKKTSVKSAKGGVITTTLGGDAKFELPTISGWKSADSLPEIAKDYSATSKAWVVATKTNSSNPTPPAPNNPVLYVDENDIHVGNHIYRATFPSTDEPPTDVYLNITGGRAFSYSVWLNSDFIGSWLGTATTEQNDQTFSFSNATLSTDEDNILVVVMDNSAHDLRDGALNPRGITNATLIGPGSYSFTEWKLAGNAGFEDHLDPVRAPLNEGSLYAERVGIHLPGYEFDEAEEVSSNSTSLTVPGAGIRVFRTVVPLSVPQGLDVSISFRLTAPSNVTFTSAEGYTNQLRALLFVNGYQYGRFNPYIGHQIDFPVPPGVLDYNGDNTIAVTVWSQSVDGAEIKVDWNVDYVHETSFDMNFDGAYLRPGWIEERREYA

SEQ ID NO: 704 - protein, 1022 aa, Artificial Sequence
  RecName: Full=Probable beta-galactosidase B; AltName: Full=Lactase B; Flags: Precursor 1022 aa protein Q0CMF3.2 GI:300681013
MARFPQLLFLLLASIGLLSAAQNHSDSEWPLHDNGLSTVVQWDHYSFHVHGQRIFVFSGEFHYWRIPVPGLWRDILEKIKAAGFTAFAFYSSWGYHAPNNHTVDFSTGARDITPIYELAKELGMYIIVRPGPYVNAEASAGGYPLWVTTGAYGSLRNDDARYTAAWKPYFAKMSEITSQYQVTDGHNTFCYQIENEYGQQWIGDPVDRNPNQTAVAYMELLEASARENGIVVPLTANDPNMNTKSWGSDWSHAGGNVDVVGLDSYPSCWTCDVTQCTSTNGEYVPYKVMQYYDYFQEVQPTMPGFMPEFQGGSYNPWAGPEGGCPGDTGVDFANLFYRWNIAQRVTAMSLYMLYGGTNWGAIAAPVTATSYDYSSPISEDRSIGSKYYETKLLALFTRSATDLTMTDRIGNGTHYTNNPAVAAYELRNPVTNGAFYVTIHADSTVGTDESFRLNVNTSAGALTVPSKGSIRLNGHQSKIIVTDFRFGPSHTLLYSTAEVLTHAVMDKKATLVLWVPTGESGEFAVKGAKSGKVERCPQCSNATFTRKKDVLVVNFTQAGGMSVLQLNNGVRVVLLDRAAAYKFWAPPLTDDPFAPETDLVLVQGPYLVRSASLSGSTLALRGDSANETALEVFASKKVHTVTWNGKRIKTSRSSYGSLTASLAAPPAVSLPALSSAQWKSQDSLPERLPSYDDSGPAWVDANHMTTQNPRTPDTLPVLYADEYGFHNGIRLWRGSFTDAASGVYLNVQGGAAFGWSAYLNGHFLGSHLGTATTSQANKTLLFPAGTLRKNTTNTILVIHDDTGHDQTTGALNPRGILAARLLAPSDSSTAPNFTQWRVAGTAGGESDLDPVRGVYNEDGLFAERMGWHLPGFDDADWPANNSTTTRGAQVSLSVTGATVRFFRAVVPLHLPRGVDASISFMLGTPAGASTAYRAQLFVNGYQYGRFYPHIGNQVVYPVPAGVLDYDGENTIGVAVWAQSEAGAEMSLDWRVNYVADSSLDAVRVAAEGALRPGWSEERLQYA

SEQ ID NO: 705 - protein, 1022 aa, Artificial Sequence
  RecName: Full=Probable beta-galactosidase B; AltName: Full=Lactase B; Flags: Precursor 1022 aa protein Q2U6P1.2 GI:300681012
MLISKTVLSGLALGASFVGVSAQQNSTRWPLHDNGLTDTVEWDHYSFLINGQRHFVFSGEFHYWRIPVPELWRDLLEKIKAAGFTAFSIYNHWGYHSPKPGVLDFENGAHNFTSIMTLAKEIGLYMIIRPGPYVNAEANAGGLPLWTTTGAYGKLRDNDPRYLEALTPYWANISKIIAPHLITNDGNVILYQIENEYAEQWLDEETHEPNTSGQEYMQYLEDVARENGIDAPLIHNLPNMNGHSWSKDLSNATGNVDVIGVDSYPTCWTCNVSECASTNGEYIPYLKLTYPQISYFKELSPTQPSFMPEFQGGSYNPWGGPQGGCPDDLGPDFANLFYRNLISQRVSAISLYMLYGGTNWGWHASTDVATSYDYSSPISENRKLIEKYYETKVLTQFTKIAQDLSKVDRLGNSTKYSSNPAVSVAELRNPDTGAAFYVTQHEYTPSGTVEKFTVKVNTSEGALTIPQYGSQITLNGHQSKIIVTDFKFGSKTLLYSTAEVLTYAVIDGKEVLALWVPTGESGEFTVKGVNSAKFADKGRTANIEIHPGTNNVTVSFMQRSGMSLVELGDGTRIVLLDRSAAHVFWSTPLNNDPAEAGNNTVLVHGPYLVRSAKLEGCDLKLTGDIQNSTEVSIFAPKSVCSVNWNGKKTSVKSAKGGVITTTLGGDAKFELPTISGWKSADSLPEIAKDYSATSKAWVVATKTNSSNPTPPAPNNPVLYVDENDIHVGNHIYRATFPSTDEPPTDVYLNITGGRAFGYSVWLNSDFIGSWLGTATTEQNDQTFSFSNATLSTDEDNILVVVMDNSAHDLRDGALNPRGITNATLIGPGSYSFTEWKLAGNAGFEDHLDPVRAPLNEGSLYAERVGIHLPGYEFDEAEEVSSNSTSLTVPGAGIRVFRTVVPLSVPQGLDVSISFRLTAPSNVTFTSAEGYTNQLRALLFVNGYQYGRFNPYIGHQIDFPVPPGVLDYNGDNTIAVTVWSQSVDGAEIKVDWNVDYVHETSFDMNFDGAYLRPGWIEERREYA

SEQ ID NO: 706 - protein, 1005 aa, Artificial Sequence; identical to SEQ ID NO: 702
  RecName: Full=Probable beta-galactosidase A; AltName: Full=Lactase A; Flags: Precursor 1005 aa protein Q2UCU3.1 GI:121801672

SEQ ID NO: 707 - protein, 984 aa, Artificial Sequence
  RecName: Full=Probable beta-galactosidase C; AltName: Full=Lactase C; Flags: Precursor 984 aa protein Q2UMD5.1 GI:121804415
MRLLSFIYLVWLALLTGTPQVSATDNGKTSDVAWDKYSLSVKGERLFVFSGEFHYQRLPVPELWLDVFQKLRANGFNTISVYFFWSYHSASEDVFDFTTGAHDIQRLFDYAKQAGLYVIARAGPYCNAETSAGGFALWAANGQMGSERTSDEAYYKKWKPWILEVGKIIAANQITNGGPVILNQHENELQETTYDSNDTKVIYMEQVAKAFEEAGVVVPSSHNEKGMRTVSWSTDYKNVGGAVNVYGLDSYPGSLSCANPNSGFNLLRTYYQWFQNYSYTQPEYLAEFEGGWFQPWGGSFYDSCASELSPEFADVYYKNNIGSRVTLHNIYMTFGGTNWGHSAAPVVYTSYDYGSPLRETREIRDKLKQTKLLGLFTRVSKDLLKTYMEGNGTSYTSDDSIYTWALRNPDSDAGFYVVAHNTSSSREVTTFSLNITTSAGAMTIPDIELDGRQSKIIVTDYSIGSESSLLYSSAEVLTYATLDVDVLVFYLNAGQKGAFVFKDAPADLKYQTYGNSNLSALETSQGTQYSYTQGEGVTAVKFSNGVLVYLLDKETAWNFFAPPTVSSPTVAPNEHILVFGPYLVRGASIKHDTVEIVGDNSNSTSIEIYTGDEHVKKVSWNGNLIDTRATAYGSLIGTVPGAEDIEISLPSLSSWKAQDTLPEISPDYDDSRWTICNKTTSVNSVAPLSLPVLYSGDYGYHTGTKIYRGRFDGQNATGANVTVQNGVAAGWAAWLNGAYVGGFSGDPDKVASWEVLKFNHSSLRSRDNVLTIITDYTGHDQNSQKPIGTQNPRGIMGATLIGGGNFTLWRIQGNAGGEKNIDPVRGPMNEGGLYGERMGWHLPGYQVPESALDSSPLEGVSGAEGRFYTTSFQLDLEEDLDVPIGLQLSAPAGTEAVVQIFMNGYQFGHYLPHIGPQSLFPFPPGVIKNRGQNSLAISMWALTDAGARLEQVELKAYAKYRSGFDFNRDWTYLQPGWKDRTEYA

SEQ ID NO: 708 - protein, 960 aa, Artificial Sequence
  RecName: Full=Probable beta-galactosidase E; AltName: Full=Lactase E; Flags: Precursor 1011 aa protein Q4WG05.1 GI:74668464
MKSLLKRLIALAAAYSVAAAPSFSHHSSQDAANKRELLQDLVTWDQHSLFVRGERLMIFSGEFHPFRLPVPGLWFDVFQKIKSLGFNAVSFYTDWGLMEGNPGHVVTDGIWSLDEFFTAAREAGLYLIARPGPYINAETSAGGIPGWVLRRKGIIRSNSEDYLRATDTYMATLGKIIAKAQITNGGPVILVQPENEYTTWPNVSESEFPTTMNQEVMAYAEKQLRDAGVVVPTVVNDNKNLGYFAPGTGLGETDLYGIDAYPMRYDCGNPYVWPTYRFPRDWQHEHRNHSPTTPFAIMEFQGGSGDGWGGVTEDGCAILVNNEAVRVVYKNNYGFGVRVFNIYMTYGGTNWGNLGYYGGYTSYDYGAAITEDRQIWREKYSEEKLQANFLKVSPAYLTSTPGNGVNGSYTGNKDITVTPLFGNGTTTNLYLVRHADFTSTGSAQYNLSISTSVGNVTIPQLGGSLSLNGRDSKFHITDYDVGGFNLIYSSAEVFTWAKGDNKKRVLVLYGGAGELHEFALPKHLPRPTVVEGSYVKIAKQGSAWVVQWEVAAQRRVLRAGKLEIHLLWRNDAYQHWVLELPAKQPIANYSSPSKETVIVKGGYLLRSAWITDNDLHLTGDVNVTTPLEVISAPKRFDGIVFNGQSLKSTRSKIGNLAATVHYQPPAISLPDLKRLDWKYIDSLPEISTEYNDEGWTPLTNTYTNNTREFTGPTCLYADDYGYHGGSLIYRGHFTANGDESWVFLNTSGGVGFANSVWLNQTFLGSWTGSGRNMTYPRNISLPHELSPGEPYVFTVVIDHMGQDEEAPGTDAIKFPRGILDYALSGHELSDLRWKMTGNLGGEQYQDLTRGPLNEGAMYAERQGYHLPSPPTSSWKSSNPIKEGLTGAGIGFYATSFSLDLPEGYDIPLSFRFNNSASAARSGTSYRCQLFVNGYQFGKYVNDLGPQTKFPVPEGILNYNG

SEQ ID NO: 709 - protein, 983 aa, Artificial Sequence; identical to SEQ ID NO: 700
  RecName: Full=Probable beta-galactosidase C; AltName: Full=Lactase C; Flags: Precursor 983 aa protein Q4WNE4.1 GI:74671041

SEQ ID NO: 710 - protein, 1015 aa, Artificial Sequence; identical to SEQ ID NO: 698
  RecName: Full=Probable beta-galactosidase B; AltName: Full=Lactase B; Flags: Precursor 1015 aa protein Q4WRD3.1 GI:74672078

SEQ ID NO: 711 - protein, 1006 aa, Artificial Sequence
  RecName: Full=Probable beta-galactosidase A; AltName: Full=Lactase A; Flags: Precursor 1006 aa protein Q4WS33.2 GI:300681010
MKLLSVCAIALLAAQAAGASIKHMLNGFTLMEHSDPAKRELLQKYVTWDEKSLFVNGERIMIFSGEVHPFRLPVPSLWLDVFQKIKALGFNCVSFYVDWALLEGKPGEYRAEGNFALEPFFDVAKQAGIYLLARPGPYINAEASGGGFPGWLQRVNGTLRTSDPAYLKATDNYIAHVAATIAKGQITNGGPVILYQPENEYSGACCDATFPDGDYMQYVIDQARNAGIVVPLINNDAWTGGHNAPGTGKGEVDIYGHDSYPLGFDCGHPSVWPKGNLPTTFRTDHLKQSPTTPYSLIEFQAGSFDPWGGPGFAACAALVNHEFERVFYKNDLSFGAAILNLYMTFGGTNWGNLGHPGGYTSYDYGSPLTESRNVTREKYSELKLIGNFVKASPSYLLATPGNLTTSGYADTADLTVTPLLGNGTGSYFVVRHTDYTSQASTPYKLSLPTSAGRLTVPQLGGTLTLNGRDSKIHVVDYNVAGTNIIYSTAEVFTWKNFGDSKVLILYGGPGEHHELAVSLKSDVQVVEGSNSEFKSKKVGDVVVVAWDVSPSRRIVQIGDLKIFLLDRNSVYNYWVPQLDKDDSSTGYSSEKTTASSIIVKAGYLVRTAYTKGSGLYLTADFNATTPVEVIGAPSNVRNLYINGEKTQFKTDKNGIWSTEVKYSAPKIKLPSMKDLDWKYLDTLQEVQSTYDDSAWPAADLDTTPNTLRPLTTPKSLYSSDYGFHTGYLIYRGHFVADGSETTFDVRTQGGSAFGSSVWLNESFLGSWTGLNANADYNSTYKLPQVEQGKNYVLTILIDTMGLNENWVVGTDEMKNPRGILSYKLSGRDASAITWKLTGNLGGEDYQDKIRGPLNEGGLYAERQGFHQPQPPSQKWKSASPLDGLSKPGIGFYTAQFDLDIPSGWDVPLYFNFGNSTKSAYRVQLYVNGYQYGKFVSNIGPQTSFPVPQGILNYQGTNWVALTLWALESDGAKLDDFELVNTTPVMTALSKIRPSKQPNYRQRKGAY

SEQ ID NO: 712 - protein, 1007 aa, Aspergillus phoenicis
  RecName: Full=Probable beta-galactosidase A; AltName: Full=Lactase A; Flags: Precursor 1007 aa protein Q4ZHV7.1 GI:74645200
MKLSSACAIALLAAQAAGASIKHRINGFTLTEHSDPAKRELLQKYVTWDDKSLFINGERIMIFSGEFHPFRLPVKELQLDIFQKVKALGFNCVSFYVDWALVEGEPGEYRADGIFDLEPFFDAASEAGIYLLARPGPYINAESSGGGFPGWLQRVNGTLRSSDKAYLDATDNYVSHVAATIAKYQITNGGPIILYQPENEYTSGCCGVEFPDPVYMQYVEDQARNAGVVIPLINNDASASGNNAPGTGKGAVDIYGHDSYPLGFDCANPTVWPSGDLPTNFRTLHLEQSPTTPYAIVEFQGGSYDPWGGPGFAACSELLNNEFERVSYKNDFSFQIAIMNLYMIFGGTNWGNLGYPNGYTSYDYGSAVTESRNITREKYSELKLLGNFAKVSPGYLTASPGNLTTSGYADTTDLTVTPLLGNSTGSFFVVRHSDYSSEESTSYKLRLPTSASSVTIPQLGGTLTLNGRDSKIHVTDYNVSGTNIIYSTAEVFTWKKFADGKVLVLYGGAGEHHELAISTKSNVTVIEGSESGISSKQTSSSVVVGWDVSTTRRIIQVGDLKILLLDRNSAYNYWVPQLATDGTSPGFSTPEKVASSIIVKAGYLVRTAYLKGSGLYLTADFNATTSVEVIGVPSTAKNLFINGDKTSHTVDKNGIWSATVDYNAPDISLPSLKDLDWKYVDTLPEIQSSYDDSLWPAADLKQTKNTLRSLTTPTSLYSSDYGFHTGYLLYRGHFTATGNESTFAIDTQGGSAFGSSVWLNGTYLGSWTGLYANSDYNATYNLPQLQAGKTYVITVVINNMGLEENWTVGEDLMKTPRGILNFLLAGRPSSAISWKLTGNLGGEDYEDKVRGPLNEGGLYAERQGFHQPEPPSQDWKSSSPLEGLSEAGIGFYSASFDLDLPKGWDVPLFLNIGNSTTPSPYRVQVYVNGYQYAKYISNIGPQTSFPVPEGILNYRGTNWLAVTLWALDSAGGKLESLELSYTTPVLTALGEVESVDQPKYKKRKGAY

SEQ ID NO: 713 - protein, 1025 aa, Artificial Sequence
  RecName: Full=Probable beta-galactosidase B; AltName: Full=Lactase B; Flags: Precursor 1025 aa protein Q5BEQ0.2 GI:300681009
MATAFWLLLFLLGSLHVLTAAQNSSQSEWPIHDNGLSKVVQWDHYSFYINGQRIFLFSGEFHYWRIPVPALWRDILEKIKAIGFTGFAFYSSWAYHAPNNQTVDFSTGARDITPIYDLAKELGMYIIVRPGPYVNAEASAGGFPLWLTTGAYGSTRNDDPRYTAAWEPYFAEVSEITSKYQVTDGHYTLCYQIENEYGQQWIGDPRDRNPNQTAIAYMELLQASARENGITVPLTGNDPNMNTKSWGSDWSDAGGNLDTVGLDSYPSCWSCDVSVCTGTNGEYVPYKVLDYYDYFQEVQPTMPFFMPEFQGGSYNPWDGPEGGCTEDTGADFANLFYRWNIGQRVSAMSLYMMFGGTNWGGIAAPVTASSYDYSAPISEDRSIGSKYYETKLLALFTRCAKDLTMTDRLGNGTQYTDNEAVIASELRNPDTNAAFYVTTHLDTTVGTDESFKLHVNTSKGALTIPRHGGTIRLNGHHSKIIVTDFNFGSETLLYSTAEVLTYAVFDRKPTLVLWVPTGESGEFAIKGAKSGSVAKCSGCSNIKFHRDSGSLTVAFTQGEGISVLQLDNGVRVVLLDRQKAYTFWAPALTDNPLVPEGESVLVSGPYLVRTARLARSTLTLRGDSKGETLEIFAPRKIKKVTWNGKAVEATRTSYGSLKAILAKPPSVELPTLNGWKYSDSLPERFPTYDDSGAAWVEIDANHMTTPNPNKPATLPVLYADEYGFHNGVRLWRGYFNSSASGVYLNIQGGAAFGWSAWLNGHFLGSHLGSASIQQANGTLDFPANTLNTEGTPNVLLVVHDDTGHDQTTGVLNPRGILEARLLSEASDNNDDDSPGFTHWRVAGTAGGESDLDPVRGVYNEDGLYAERVGWHLPGFDDSKWATVNGTSLSFTGATVRFFRTVIPPLSIPENTDVSISFVFSTPNVNNTSAGNTSAFRAQLFVNGYQYGRYNPYVGNQVVYPVPPGILDYNGENTIGVAVWAQTEAGARLNLDWRVNYVLGSSLDAGRLDLSFVAIAYVYIFECLQL

SEQ ID NO: 714 - protein, 1007 aa, Artificial Sequence
  RecName: Full=Probable beta-galactosidase A; AltName: Full=Lactase A; Flags: Precursor 1007 aa protein Q5BFC4.2 GI:300681016
MRLLPVWTAALLAAQAAGVALTHKLNGFTITEHPDAEKRELLQKYVTWDDKSLFINGERIMIFGAEIHPWRLPVPSLWRDILQKVKALGFNCVSFYVDWALLEGKPGEYRAEGSFAWEPFFDAASDLGIYLIARPGPYINAEASGGGFPGWLQRLNGTIRSSDQSYLDATENYVSHIGGLIAKYQITNGGPVILYQPDNEYSGGCCGQEFPNPDYFQYVIDQARRAGIVVPTISNDAWPGGHNAPGTGKGEVDIYGHDNYPLGFDCANPDVWPEGNLPTDYRDLHLEISPSTPYALVEYQVGAFDPWGGPGFEQCAALTGYEFERVFHKNTFSFGVGILSLYMTFGGTNWGNLGHPGGYTSYDYGSPIKETREITREKYSELKLLGNFIKSSPGYLLATPGKLTNTTYTNTADLTVTPLLGNGTGSFFVLRHSDYSSQASTPYKLRLPTSAGQLTIPQLGGSLVLNGRDSKVHLVDYDVAGTKILYSTAEVFTWKKFHDGKVLVLYGGPGEHHELAVSSKAKVKVVEGLGSGISSKQIRGAVVVAWDVEPARRIVQIGDLKIFLLDRNSAYNYWVPQLGTETSIPYATEKAVAASVIVKAGYLVRTAYVKGRDLHLTADFNATTPVEVIGAPKTAENLFINGKKAHHTVDKNGIWSTEVGYSPPKIVLPVLEDLKWKSIDTLPEIQPSYDDSPWPDANLPTKNTIYPLRTPTSLYASDYGFHTGYLLFRGHFTANGRESNFSIQTQGGQAFGSSVWLSGTYLGSWTGDNDYQDYNATYTLPSLKAGKEYVFTVVVDNMGLNENWIVGQDEMKKPRGILNYELSGHEASDITWKLTGNFGGEDYVDKVRGPLNEGGLYAERHGYHQPYPPTKSKDWKSSTPLTGLSKPGISFYTASFDLDIKSGWDVPIYFEFGNSTTPAPAYRVQLYVNGWQYGKYVNNIGPQTRFPVPEGILNYKGTNWVAVTLWALEGSGAKLDSFKLVHGIPVRTALDVEGVELPRYQSRKGVY

SEQ ID NO: 715 - protein, 988 aa, Artificial Sequence
  lactase, partial [Aspergillus niger] 988 aa protein ABL07484.1 GI:118582212
SIKHRINGFTLTEHSDPAKRELLQKYVTWDDKSLFINGERIMIFSGEFHPFRLPVKELQLDIFQKVKALGFNCVSFYVDWALVEGKPGEYGADGIFDLEPFFDAASEAGIYLLARPGPYINAESSGGGFPGWLQRVNGTLRTSDKAYLEATDNYVSHIAATIAKYQITNGGPIILYQPENEYTGGCCGVEFPDPVYMQYVEDQARNAGVVIPLINNDASASGHNAPGTGEGAVDIYGHDSYPLGFDCANPTVWPSGDLPTNFRTLHLVQSPTTPYAIVEFQGGSYDPWGGPGFAACSELLNNEFERVFYKNDFSFQIAIMNLYMIFGGTNWGNLGYPNGYTSYDYGSAVTESRNITREKYSELKLLGNFAKVSPGYLTASPGNLTTSGYADTTDLTVTPLLGNSTGSFFVVRHSDYSSEDSTSYKLRLPTSAGTVTIPQLGGTLTLNGRDSKIHVTDYNVSGTNIIYSTAEVFTWKKFADGKVLVLYGGAGEHHELAISTKSNVTVIEGSESGISSKQTSSSVIVGWDVSTTRRIIQVGDLKVLLLDRNSAYNYWVPQLATDGTSPGFSTSETVASSIIVKAGYLVRTAYLKGSGLYLTADFNATTSVEVIGVPSTAKNLFINGDKTSHTVDKNGIWSATVEYNAPDISLPSLKDLDWKYVDTLPEIQSSYDDSLWPAADLKQTKNTLRSLTTPTSLYSSDYGFHTGYLLYRGHFTATGNESTFSIDTQGGSAFGSSVWLNGTYLGSWTGLYVNSDYNATYKLPQLQAGKSYVITVVIDNMGLEENWTVGEDLMKTPRGILNFLLAGRPGSAISWKLTGNLGGEDYEDKVRGPLNEGGLYAERQGFHQPEPPSGNWKSSSPLEGLSEAGIGFYSAKFDLDLPKGWDVPLFLNIGNSTTPSPYRVQVYVNGYQYAKYISNNGPQTSFPVPEGILNYRGTNWLAVTLWALDSAGGKLESLELSYTTPVLTALGEVESVDQPKYKKRKGAY

SEQ ID NO: 716 - protein, 438 aa, Artificial Sequence
  unnamed protein product [Aspergillus oryzae RIB40] 438 aa protein BAE57671.1 GI:83767532
MGSTSTSTLPPDFLWGFATASYQIEGAVNEDGRGPSIWDTFCKIPGKIAGGANGDVACDSYHRTHEDIALLKACGAKAYRFSLSWSRIIPLGGRNDPINEKGLQYYIKFVDDLHAAGITPLVTLFHWDLPDELDKRYGGLLNKEEFVADFAHYARIVFKAFGSKVKHWITFNEPWCSSVLGYNVGQFAPGRTSDRSKSPVGDSSRECWIVGHSLLVAHGAAVKIYRDEFKASDGGEIGITLNGDWAEPWDPENPADVEACDRKIEFAISWFADPIYHGKYPDSMVKQLGDRLPKWTPEDIALVHGSNDFYGMNHYCANFIKAKTGEADPNDTAGNLEILLQNKKGEWVGPETQSPWLRPSAIGFRKLLKWLSERYNYPKIYVTENGTSLKGENDLPLEQLLQDDFRTQYFRDYIGAMADAYTLDGVNVRAYMAWSLME

SEQ ID NO: 717 - protein, 458 aa, Artificial Sequence
  unnamed protein product [Aspergillus oryzae RIB40] 458 aa protein BAE62705.1 GI:83772577
MARVRLKLPADFIWGVSSSSWQIEGGLQLEGRGPSVLDTIGNVLSPEAADRSDANVANMHYFMYEQDIARLAAAGIPYYSFSLSWPRIVPFGVAGSPVNTQGLDHYDDLINTCIKYGVTPIVTLNHVDAPTAVQADLDSLPEHFLYYAKIVMTRYADRVPYWVTFNEPNIGVGTLFQKYQDLTSALIAHADVYDWYKNTLGGTGKITMKFANNLAMPLDTQDSSHIAAASRYQDILLGIMSNPLFLGKQYPDAAIDTVDMMQPLTDDQIKHIHGKIDFWSFDPYTAQYASPLPQGTEACASNSSDPFWPTCVILSNVQANGWLMGQASNAYAYLAPQYVRQQLGYIWNTFRPSGILIAEYGFNPFLESNRTLDAQRYDLERTLYYQDFLTETLKAIHEDNVNVIGALAWSIADNNEFGSYEEQYGLQTVNRTNGKFTRTYKRSLFDYVDFFHRHVQSA

SEQ ID NO: 718 - protein, 506 aa, Artificial Sequence
  unnamed protein product [Aspergillus oryzae RIB40] 506 aa protein BAE63197.1 GI:83773069
MNVNMFKAGDDILQDVDQSCKDRLPAVEELPLPPSFTWGTATAAYQVEGGAFQDGKGKSIWDTFTHLDPSRTNGENGDIACDHYNRMAEDVVLMASYGVDVYRFSIAWARILPLGGRGDPINEKGIAFYNNLIDCLLEHNIEPVVTLYHWDVPQGLYDRYGAFLDTTEFRADFEHFARLCFSRFGDRVKRWITFNEPYIISIFGHHSGVLAPGRSSATGGDSRTEPWRVGHTIILAHTAAVQAYATDFQPTQKGDISIVLNGHYYEPWDAGSEEHRLAAQRRLEFYIGWFGDPIFLGKDYPAPMRAQLGSRLPEFTSEELDLLRRSAPINSFYGMNHYTTKYARALPDPPAEDDCTGNVEEGPTNSEGKTMGPLSGMSWLRVTPAGFRKLLNWVWDRYRRPIVVTENGCPCPGESQMTKEQALDDQFRIRYFGLYLDAISRAIYDDGVKVEGYYVWSLMDNFEWSAGYGPRYGITHVDFTTLVRTPKQSAKYLHHSFNKRRATSLR

SEQ ID NO: 719 - protein, 1055 aa, Artificial Sequence
  beta-galactosidase [Aspergillus fumigatus Af293] 1055 aa protein XP_753202.1 GI:70996895
MTLSAVPDYENQHILQRNRLKPRAYFLPATSISLNGRWDFHYAASPVSAPEPTWSKGTKNATAEPRRDSNQFSSDGADSKTAWAPITVPGHWQLQGYGRPHYTNVIYPFPVCPPFVPTENPTGTYRRTFHVPAEWDASSQLRLRFDGVDSAYHVWVNGVPIGYSQGSRNPAEFDVSQVVDRDGANELFVRVYQWSDGSYIEDQDQWWLSGIFRDVTLLAFPGQARIEDFFVRTALDKDYVDATLRLSVDLALATAAIVQVTLSNPSTGSTLQTEKYSLGEKQDKLEAELSVSNPNKWTAETPNLYNLCIALYVDGAKDPVQTINHRVGFRQVEIKNGNITVNGVPVMFRGVNRHDHHPRFGRAVPLSFLREDLLIMKRHNVNALRCSHYPSHPRLYELCDELGLWVMDEADLECHGFYDAIARPLDIPESMDYEERKKLTFGQAAQFTTNNPEWKEAYVDRMAQMVQRDKNHSCIVIWSLGNEAFYGSNHQAMYDYVKQVDPSRPVHYEGDMEAKTVDMYSYMYPSLERLVGFATAEGDEFKKPIVLCEYAHAMGNAPGGLEEYMEAFRTHRRLQGGWVWEWANHGLWDEKKGWYGYGGDFGDTPHDGNFVLDGLLFSDHTPTPGITELKKAYAPVRVWPGEDGTLVVANDYNFVGLEGLQASYKIEVLGDSGRIIATGIIELPPIPAGQNGTIKLPSAPATAIPGEVWLTISFLQKGETAWAGNNYEVAWYQQCLKSSSPRFSLAVPAEALTHSSTKTSHRISGASFSLEFSRETGSLYAWTAGGLSLLDQSSSTGAISPGFWRPPTDNDMSHDLLEWRRFGLDTLTSQLRKMHVVQHTPTSVEVTTETYISAPILGWGFFASTSYTISGNGALTVNVHLKPHGPMPADLPRLGLDVLLADELDNTSWFGLGPGEAYPDKKRAQKVGIYNAATAELHTPYEVPQEGGNRMDTRWLRVHDSRGWGLRVTRVKDESDKQPTELFQWLATRYSPEAIEAAKHAPELVPEKRIRLRLDVESCGVGTGACGPRTLDKYRVKCEERKFGFTLQPVLAELC

SEQ ID NO: 720 - protein, 1055 aa, Artificial Sequence; identical to SEQ ID NO: 719
  beta-galactosidase, putative [Aspergillus fumigatus Af293] 1055 aa protein EAL91164.1 GI:66850838

SEQ ID NO: 721 - protein, 1005 aa, Artificial Sequence
  beta-galactosidase [Aspergillus candidus] 1005 aa protein CAD24293.1 GI:18958133
MKLLSVAAVALLAAQAAGASIKHRLNGFTILEHPDPAKRDLLQDIVTWDDKSLFINGERIMLFSGEVHPFRLPVPSLWLDIFHKIRALGFNCVSFYIDWALLEGKPGDYRAEGIFALEPFFDAAKEAGIYLIARPGSYINAEVSGGGFPGWLQRVNGTLRSSDEPFLKATDNYIANAAAAVAKAQITNGGPVILYQPENEYSGGCCGVKYPDADYMQYVMDQARKADIVVPFISNDASPSGHNAPGSGTGAVDIYGHDSYPLGFDCANPSVWPEGKLPDNFRTLHLEQSPSTPYSLLEFQAGAFDPWGGPGFEKCYALVNHEFSRVFYRNDLSFGVSTFNLYMTFGGTNWGNLGHPGGYTSYDYGSPITETRNVTREKYSDIKLLANFVKASPSYLTATPRNLTTGVYTDTSDLAVTPLMGDSPGSFFVVRHTDYSSQESTSYKLKLPTSAGNLTIPQLEGTLSLNGRDSKIHVVDYNVSGTNIIYSTAEVFTWKKFDGNKVLVLYGGPKEHHELAIASKSNVTIIEGSDSGIVSTRKGSSVIIGWDVSSTRRIVQVGDLRVFLLDRNSAYNYWVPELPTEGTSPGFSTSKTTASSIIVKAGYLLRGAHLDGADLHLTADFNATTPIEVIGAPTGAKNLFVNGEKASHTVDKNGIWSSEVKYAAPEIKLPGLKDLDWKYLDTLPEIKSSYDDSAWVSADLPKTKNTHRPLDTPTSLYSSDYGFHTGYLIYRGHFVANGKESEFFIRTQGGSAFGSSVWLNETYLGSWTGADYAMDGNSTYKLSQLESGKNYVITVVIDNLGLDENWTVGEETMKNPRGILSYKLSGQDASAITWKLTGNLGGEDYQDKVRGPLNEGGLYAERQGFHQPQPPSESWESGSPLEGLSKPGIGFYTAQFDLDLPKGWDVPLYFNFGNNTQAARAQLYVNGYQYGKFTGNVGPQTSFPVPEGILNYRGTNYVALSLWALESDGAKLGSFELSYTTPVLTGYGDVESPEQPKYEQRKGAY

SEQ ID NO: 722 - protein, 1006 aa, Artificial Sequence
  RecName: Full=Beta-galactosidase; AltName: Full=Lactase-N; Short=Lactase; AltName: INN=Tilactase; Flags: Precursor 1006 aa protein P29853.2 GI:461623
MKLSSACAIALLAAQAAGASIKHRINGFTLTEHSDPAKRELLQKYVTWDDKSLFINGERIMIFSGEFHPFRLPVKELQLDIFQKVKALGFNCVSFYVDWALVEGKPGEYRADGIFDLEPFFDAASEAGIYLLARPGPYINAESSGGGFPGWLQRVNGTLRSSDKAYLDATDNYVSHVAATIAKYQITNGGPIILYQPENEYTSGCSGVEFPDPVYMQYVEDQARNAGVVIPLINNDASASGNNAPGTGKGAVDIYGHDSYPLGFDCANPTVWPSGDLPTNFRTLHLEQSPTTPYAIVEFQGGSYDPWGGPGFAACSELLNNEFERVFYKNDFSFQIAIMNLYMIFGGTNWGNLGYPNGYTSYDYGSAVTESRNITREKYSELKLLGNFAKVSPGYLTASPGNLTTSGYADTTDLTVTPLLGNSTGSFFVVRHSDYSSEESTSYKLRLPTSAGSVTIPQLGGTLTLNGRDSKIHVTDHNVSGTNIIYSTAEVFTWKKFADGKVLVLYGGAGEHHELAISTKSNVTVIEGSESGISSKQTSSSVVVGWDVSTTRRIIQVGDLKILLLDRNSAYNYWVPQLATDGTSPGFSTPEKVASSIIVKAGYLVRTAYLKGSGLYLTADFNATTSVEVIGVPSTAKNLFINGDKTSHTVDKNGIWSATVDYNAPDISLPSLKDLDWKYVDTLPEIQSSYDDSLWPAADLKQTKNTLRSLTTPTSLYSSDYGFHTGYLLYRGHFTATGNESTFAIDTQGGSAFGSSVWLNGTYLGSWTGLYANSDYNATYNLPQLQAGKTYVITVVIDNMGLEENWTVGEDLMKSPRGISTSCLPDGQAAPISWKLTGNLGGEDYEDKVRGPLNEGGLYAERQGFHQPEPPSQNWKSSSPLEGLSEAGIGFYSASFDLDLPKDGMSHCSSTSVTALRHPRTACRSTSTDIVCEIHKQHRTSDQLPCPRGNPELSRNELVGGDPVALDSAGGKLESLELSYTTPVLTALGEVESVDQPKYKKRKGAY

SEQ ID NO: 723 - protein, 227 aa, Artificial Sequence; identical to SEQ ID NO: 165
  Alpha-glucosidase P1 subunit, ANP P1 subunit Aspergillus niger, Peptide, 227 aa AAB2358.1 GI:257186 (transglucosidase)
  VARIANT 11, 99, 118, 193: Xaa = Any Amino Acid

SEQ ID NO: 724 - protein, 834 aa, Artificial Sequence; identical to SEQ ID NO: 385
  Celluclast hypothetical protein M419DRAFT_125268 [Trichoderma reesei RUT C-3] 834 aa protein ETR97394.1 GI:57227381

SEQ ID NO: 725 - protein, 490 aa, Artificial Sequence
  RecName: Full=Velvet complex subunit 2 49 aa protein GRS98.2 GI:1881915
MPSLIPPIVSASSASNSAALDHLYHHQPPPRLPLGAVPQSPIQSQAPPPPHLHPPSHHFQLHPGHGHHQQPHHERDHRLPPPVASYSAHSHHLQHDPLPQRLESSQPGHPGAAEHRDHPQHALDEPSRSHDPYPSMATGALVHSESQQPASASLLLPISNVEEATGRRYHLDVVQQPRRARMCGFGDKDRRPITPPPCVRLIIIDVATGKEIDCNDIDHSMFVLNVDLWNEDGTREVNLVRSSTSSSPSVSSTVTYPYGSISVGESSHTYGQSAHPPSREAPYSVSQTASYAPEYQTQPTYSQGSSAYPSNGTYGPPQQYFPQHQAYRTETGPPGAMQTTVGGFRGYAQDQNALTKMAVVGGQPQGMFTRNLIGSLAASAFRLADTSEHLGIWFVLQDLSVRTEGPFRLRFSFVNVGPLAGQNGAKVNTGRAPILASCFSEVFNVYSAKKFPGVCESTPLSKTFAAQGIKIPIRKDANLKGGDGEDDYGD

SEQ ID NO: 726 - protein, 500 aa, Artificial Sequence
  alpha-L-arabinofuranosidase [Trichoderma reesei] 5 aa protein CAA93243.1 GI:158814
MLSNARIIAAGCIAAGSLVAAGPCDIYSSGGTPCVAAHSTTRALFSAYTGPLYQVKRGSDGATTAISPLSSGVANAAAQDAFCAGTTCLITIIYDQSGRGNHLTQAPPGGFSGPESNGYDNLASAIGAPVTLNGQKAYGVFVSPGTGYRNNAASGTAKGDAAEGMYAVLDGTHYNGACCFDYGNAETNSRDTGNGHMEAIYFGDSTVWGTGSGKGPWIMADLENGLFSGSSPGNNAGDPSISYRFVTAAIKGQPNQWAIRGGNAASGSLSTFYSGARPQVSGYNPMSKEGAIILGIGGDNSNGAQGTFYEGVMTSGYPSDATENSVQANIVAARYAVAPLTSGPALTVGSSISLRATTACCTTRYIAHSGSTVNTQVVSSSSATALKQQASWTVRAGLANNACFSFESRDTSGSYIRHSNFGLVLNANDGSKLFAEDATFCTQAGINGQGSSIRSWSYPTRYFRHYNNTLYIASNGGVHVFDATAAFNDDVSFVVSGGFA

SEQ ID NO: 727 - protein, 797 aa, Artificial Sequence
  beta-xylosidase [Trichoderma reesei] 797 aa protein CAA93248.1 GI:2791278
MVNNAALLAALSALLPTALAQNNQTYANYSAQGQPDLYPETLATLTLSFPDCEHGPLKNNLVCDSSAGYVERAQALISLFTLEELILNTQNSGPGVPRLGLPNYQVWNEALHGLDRANFATKGGQFEWATSFPMPILTTAALNRTLIHQIADIISTQARAFSNSGRYGLDVYAPNVNGFRSPLWGRGQETPGEDAFFLSSAYTYEYITGIQGGVDPEHLKVAATVKHFAGYDLENWNNQSRLGFDAIITQQDLSEYYTPQFLAAARYAKSRSLMCAYNSVNGVPSCANSFFLQTLLRESWGFPEWGYVSSDCDAVYNVFNPHDYASNQSSAAASSLRAGTDIDCGQTYPWHLNESFVAGEVSRGEIERSVTRLYANLVRLGYFDKKNQYRSLGWKDVVKTDAWNISYEAAVEGIVLLKNDGTLPLSKKVRSIALIGPWANATTQMQGNYYGPAPYLISPLEAAKKAGYHVNFELGTEIAGNSTTGFAKAIAAAKKSDAIIYLGGIDNTIEQEGADRTDIAWPGNQLDLIKQLSEVGKPLVVLQMGGGQVDSSSLKSNKKVNSLVWGGYPGQSGGVALFDILSGKRAPAGRLVTTQYPAEYVHQFPQNDMNLRPDGKSNPGQTYIWYTGKPVYEFGSGLFYTTFKETLASHPKSLKFNTSSILSAPHPGYTYSEQIPVFTFEANIKNSGKTESPYTAMLFVRTSNAGPAPYPNKWLVGFDRLADIKPGHSSKLSIPIPVSALARVDSHGNRIVYPGKYELALNTDESVKLEFELVGEEVTIENWPLEEQQIKDATPDA

SEQ ID NO: 728 - protein, 797 aa, Artificial Sequence; identical to SEQ ID NO: 727
  unnamed protein product [Trichoderma reesei] 797 aa protein CAW52645.1 GI:219752323

SEQ ID NO: 729 - protein, 797 aa, Artificial Sequence; identical to SEQ ID NO: 727
  unnamed protein product [Trichoderma reesei] 797 aa protein CBC2392.1 GI:257341433

SEQ ID NO: 730 - protein, 766 aa, Artificial Sequence
  Chain A, The Structure Of Hypocrea Jecorina Beta-xylosidase Xyl3a (bxl1) 766 aa protein 5A7M_A GI:152244671
  VARIANT 1: Xaa = Any Amino Acid
XNNQTYANYSAQGQPDLYPETLATLTLSFPDCEHGPLKNNLVCDSSAGYVERAQALISLFTLEELILNTQNSGPGVPRLGLPNYQVWNEALHGLDRANFATKGGQFEWATSFPMPILTTAALNRTLIHQIADIISTQARAFSNSGRYGLDVYAPNVNGFRSPLWGRGQETPGEDAFFLSSAYTYEYITGIQGGVDPEHLKVAATVKHFAGYDLENWNNQSRLGFDAIITQQDLSEYYTPQFLAAARYAKSRSLMCAYNSVNGVPSCANSFFLQTLLRESWGFPEWGYVSSDCDAVYNVFNPHDYASNQSSAAASSLRAGTDIDCGQTYPWHLNESFVAGEVSRGEIERSVTRLYANLVRLGYFDKKNQYRSLGWKDVVKTDAWNISYEAAVEGIVLLKNDGTLPLSKKVRSIALIGPWANATTQMQGNYYGPAPYLISPLEAAKKAGYHVNFELGTEIAGNSTTGFAKAIAAAKKSDAIIYLGGIDNTIEQEGADRTDIAWPGNQLDLIKQLSEVGKPLVVLQMGGGQVDSSSLKSNKKVNSLVWGGYPGQSGGVALFDILSGKRAPAGRLVTTQYPAEYVHQFPQNDMNLRPDGKSNPGQTYIWYTGKPVYEFGSGLFYTTFKETLASHPKSLKFNTSSILSAPHPGYTYSEQIPVFTFEANIKNSGKTESPYTAMLFVRTSNAGPAPYPNKWLVGFDRLADIKPGHSSKLSIPIPVSALARVDSHGNRIVYPGKYELALNTDESVKLEFELVGEEVTIENWPLE

SEQ ID NO: 731 - protein, 766 aa, Artificial Sequence; identical to SEQ ID NO: 730
  Chain B, The Structure Of Hypocrea Jecorina Beta-xylosidase Xyl3a (bxl1) 766 aa protein 5A7M_B GI:152244672
  VARIANT 1: Xaa = Any Amino Acid

SEQ ID NO: 732 - protein, 767 aa, Artificial Sequence
  Chain A, The Structure Of Hypocrea Jecorina Beta-xylosidase Xyl3a (Bxl1) In Complex With 4-thioxylobiose 767 aa protein 5AE6_A GI:169428461
  VARIANT 1: Xaa = Any Amino Acid
XNNQTYANYSAQGQPDLYPETLATLTLSFPDCEHGPLKNNLVCDSSAGYVERAQALISLFTLEELILNTQNSGPGVPRLGLPNYQVWNEALHGLDRANFATKGGQFEWATSFPMPILTTAALNRTLIHQIADIISTQARAFSNSGRYGLDVYAPNVNGFRSPLWGRGQETPGEDAFFLSSAYTYEYITGIQGGVDPEHLKVAATVKHFAGYDLENWNNQSRLGFDAIITQQDLSEYYTPQFLAAARYAKSRSLMCAYNSVNGVPSCANSFFLQTLLRESWGFPEWGYVSSDCDAVYNVFNPHDYASNQSSAAASSLRAGTDIDCGQTYPWHLNESFVAGEVSRGEIERSVTRLYANLVRLGYFDKKNQYRSLGWKDVVKTDAWNISYEAAVEGIVLLKNDGTLPLSKKVRSIALIGPWANATTQMQGNYYGPAPYLISPLEAAKKAGYHVNFELGTEIAGNSTTGFAKAIAAAKKSDAIIYLGGIDNTIEQEGADRTDIAWPGNQLDLIKQLSEVGKPLVVLQMGGGQVDSSSLKSNKKVNSLVWGGYPGQSGGVALFDILSGKRAPAGRLVTTQYPAEYVHQFPQNDMNLRPDGKSNPGQTYIWYTGKPVYEFGSGLFYTTFKETLASHPKSLKFNTSSILSAPHPGYTYSEQIPVFTFEANIKNSGKTESPYTAMLFVRTSNAGPAPYPNKWLVGFDRLADIKPGHSSKLSIPIPVSALARVDSHGNRIVYPGKYELALNTDESVKLEFELVGEEVTIENWPLEE

SEQ ID NO: 733 - protein, 737 aa, Artificial Sequence
  Chain B, The Structure Of Hypocrea Jecorina Beta-xylosidase Xyl3a (Bxl1) In Complex With 4-thioxylobiose 767 aa protein 5AE6_B GI:169428462
  VARIANT 1: Xaa = Any Amino Acid
XNNQTYANYSAQGQPDLYPETLATLTLSFPDCEHGPLKNNLVCDSSAGYVERAQALISLFTLEELILNTQNSGPGVPRLGLPNYQVWNEAALNRTLIHQIADIISTQARAFSNSGRYGLDVYAPNVNGFRSPLWGRGQETPGEDAFFLSSAYTYEYITGIQGGVDPEHLKVAATVKHFAGYDLENWNNQSRLGFDAIITQQDLSEYYTPQFLAAARYAKSRSLMCAYNSVNGVPSCANSFFLQTLLRESWGFPEWGYVSSDCDAVYNVFNPHDYASNQSSAAASSLRAGTDIDCGQTYPWHLNESFVAGEVSRGEIERSVTRLYANLVRLGYFDKKNQYRSLGWKDVVKTDAWNISYEAAVEGIVLLKNDGTLPLSKKVRSIALIGPWANATTQMQGNYYGPAPYLISPLEAAKKAGYHVNFELGTEIAGNSTTGFAKAIAAAKKSDAIIYLGGIDNTIEQEGADRTDIAWPGNQLDLIKQLSEVGKPLVVLQMGGGQVDSSSLKSNKKVNSLVWGGYPGQSGGVALFDILSGKRAPAGRLVTTQYPAEYVHQFPQNDMNLRPDGKSNPGQTYIWYTGKPVYEFGSGLFYTTFKETLASHPKSLKFNTSSILSAPHPGYTYSEQIPVFTFEANIKNSGKTESPYTAMLFVRTSNAGPAPYPNKWLVGFDRLADIKPGHSSKLSIPIPVSALARVDSHGNRIVYPGKYELALNTDESVKLEFELVGEEVTIENWPLEE

SEQ ID NO: 734 - protein, 553 aa, Artificial Sequence
  glycoside hydrolase family 43 [Trichoderma reesei QM6a] 553 aa protein EGR49145.1 GI:3451895
MPLIRNPILPGFNADPSIVRVGSDYYIATSTFEWYPGVQIHHSTDLANWELAVRPLSRRSQLDLRGEPDSCGVWAPCLTHDGDKFWLVYTDVKRKDGSFKDTHNYIVTAPRIEGPWSDPVYANSSGFDPSLFHDDDGRKWLVNMVQDHRARPRTFAGIALQEFDPAQGKLVGTRKVVFHGSELGLVEGPHLYKRNGWYYLLTAEGGTGYTHAATLARSRSIWGPYELHPQQHILTSKDHPFAALQRAGHADIVETADGKTYLVHLAGRPIGQKRRCVLGRETALQEAYWGEDDWLYVKNGPVPSLDVEVPGVRDEEAYWKEKRYEFHDGLHKDFQWLRTPEPERLFAIEDGKLVLTGRESIGSWFEQSLVARRQTHFSFDAETVIDFSPEDERQFAGLTLYYSRYNFFYLAVSAHSDGRREVQILRSEASWPNGKLEDVGANACYVRIPQQGRVKLAATIRGERLQFYYALVAEGGEEQEELQRIGPVLDASIVSDECGGHQAHGSFTGSFVGVACSDVNGTEKRAVFDYFVYRPAHDSTDRYSVSMEGIQRV

SEQ ID NO: 735 - protein, 797 aa, Artificial Sequence; identical to SEQ ID NO: 727
  glycoside hydrolase family 3 [Trichoderma reesei QM6a] 797 aa protein EGR4972.1 GI:34519464

SEQ ID NO: 736 - protein, 796 aa, Artificial Sequence
  glycoside hydrolase family 3 [Trichoderma reesei QM6a] 796 aa protein EGR586.1 GI:34519849
MRVNVPLHALQIAARSVAAAICKSSSASGRSLRGGKIDQASRINIYSISNPSPNPPLTPSFPDCTRDPLCSNDVCDTTKSIAERAAAIVKPMTLNEKVANVGSSASGSARLGLPAYQWQNEALHGVAGSTGVQFQSPLGANFSAATSFPMPILLSAAFDDALVKSVATAISTEARAFANYGFAGLDFWTPNINPFRDPRWGRGMETPGEDAFRIQGYVLALVDGLQGGIDPDFYRTLSTCKHFAAYDIENGRTANNLSPTQQDMADYYLPMFETCVRDAKVASIMCAYNAVDGVPACADSYLLQDVLRDTYGFTEDFNYVVSDCDAVENVFDPHHYAANLTQAAAMSINAGTDLDCGSSYNVLNASVQAGLTTEATLDKSLIRLYSALVKVGYFDQPAEYNSLGWGNVNTTQSQALAHDAATEGMTLLKNDGTLPLSRTLSNVAVIGPWANVTTQMQGNYAGTAPLLVNPLSVFQQKWRNVKYAQGTAINSQDTSGFNAALSAASSSDVIVYLGGIDISVENEGFDRSSITWPGNQLNLISQLANLGKPLVIVQFGGGQIDDSALLSNSKVNSILWAGYPGQDGGNAIFDVLTGANPPAGRLPVTQYPANYVNNNNIQDMNLRPSNGIPGRTYAWYTGTPVLPFGYGLHYTNFSLSFQSTKTAGSDIATLVNNAGSNKDLATFATIVVNVKNTGGKANLASDYVGLLFLKSTNAGPAPHPNKQLAAYGRVRNVGVGATQQLTLTVNLGSLARADTNGDRWIYPGAYTLILDVNGPLTFNFTLTGTATKISTLPSRS

SEQ ID NO: 737 - protein, 796 aa, Artificial Sequence; identical to SEQ ID NO: 736
  glycoside hydrolase family 3 [Trichoderma reesei QM6a] 796 aa protein XP_6963621.1 GI:58913197

SEQ ID NO: 738 - protein, 797 aa, Artificial Sequence; identical to SEQ ID NO: 727
  glycoside hydrolase family 3 [Trichoderma reesei QM6a] 797 aa protein XP_696475.1 GI:5891415

SEQ ID NO: 739 - protein, 553 aa, Artificial Sequence; identical to SEQ ID NO: 734
  glycoside hydrolase family 43 [Trichoderma reesei QM6a] 553 aa protein XP_6964816.1 GI:58915587

SEQ ID NO: 740 - protein, 553 aa, Artificial Sequence; identical to SEQ ID NO: 734
  family 43 glycoside hydrolase [Trichoderma reesei RUT C-3] 553 aa protein ETS2497.1 GI:572279375

SEQ ID NO: 741 - protein, 797 aa, Artificial Sequence; identical to SEQ ID NO: 727
  beta-xylosidase [Trichoderma reesei RUT C-3] 797 aa protein ETS3193.1 GI:5722896

SEQ ID NO: 742 - protein, 860 aa, Artificial Sequence
  glycoside hydrolase [Trichoderma reesei RUT C-3] 8 aa protein ETS3636.1 GI:57228576
MALFHLAQARTCLPPYQAQTTYQGCYHDPNSPRDLAGPMLTVGNLNSPQYCANICGAAGYQYSGVEFTIQCFCGHRIESTSVKADESQCSSPCPADSSKVCGGGNMINIYSISNPSPNPPLTPSFPDCTRDPLCSNDVCDTTKSIAERAAAIVKPMTLNEKVANVGSSASGSARLGLPAYQWQNEALHGVAGSTGVQFQSPLGANFSAATSFPMPILLSAAFDDALVKSVATAISTEARAFANYGFAGLDFWTPNINPFRDPRWGRGMETPGEDAFRIQGYVLALVDGLQGGIDPDFYRTLSTCKHFAAYDIENGRTANNLSPTQQDMADYYLPMFETCVRDAKVASIMCAYNAVDGVPACADSYLLQDVLRDTYGFTEDFNYVVSDCDAVENVFDPHHYAANLTQAAAMSINAGTDLDCGSSYNVLNASVQAGLTTEATLDKSLIRLYSALVKVGYFDQPAEYNSLGWGNVNTTQSQALAHDAATEGMTLLKNDGTLPLSRTLSNVAVIGPWANVTTQMQGNYAGTAPLLVNPLSVFQQKWRNVKYAQGTAINSQDTSGFNAALSAASSSDVIVYLGGIDISVENEGFDRSSITWPGNQLNLISQLANLGKPLVIVQFGGGQIDDSALLSNSKVNSILWAGYPGQDGGNAIFDVLTGANPPAGRLPVTQYPANYVNNNNIQDMNLRPSNGIPGRTYAWYTGTPVLPFGYGLHYTNFSLSFQSTKTAGSDIATLVNNAGSNKDLATFATIVVNVKNTGGKANLASDYVGLLFLKSTNAGPAPHPNKQLAAYGRVRNVGVGATQQLTLTVNLGSLARADTNGDRWIYPGAYTLILDVNGPLTFNFTLTGTATKISTLPSRS

SEQ ID NO: 743 - protein, 434 aa, Artificial Sequence
  Chain B, The Three-Dimensional Crystal Structure Of The Catalytic Core Of Cellobiohydrolase I From Trichoderma Reesei 434 aa protein 1CEL_B GI:89287
  VARIANT 1: Xaa = Any Amino Acid
XSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 744 - protein, 434 aa, Artificial Sequence; identical to SEQ ID NO: 743
  Chain A, The Three- Dimensional Crystal Structure Of The Catalytic Core Of Cellobiohydrolase I From Trichoderma Reesei 434 aa protein 1CEL_A GI:89286
  VARIANT 1: Xaa = Any Amino Acid

SEQ ID NO: 745 - protein, 365 aa, Artificial Sequence
  Chain A, Three-Dimensional Structure Of Cellobiohydrolase From Trichoderma Reesei 365 aa protein 3CBH_A GI:157836775
SGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 746 - protein, 36 aa, Artificial Sequence
  2CBH_A GI:157834734
TQSHYGQCGGIGYSGPTVCASGTTCQVLNPYYSQCL

SEQ ID NO: 747 - protein, 36 aa, Artificial Sequence
  Chain A, Three-Dimensional Structures Of Three Engineered Cellulose- Binding Domains Of Cellobiohydrolase I From Trichoderma Reesei, Nmr, 19 Structures 36 aa protein 1AZK_A GI:15783159
TQSHYGQCGGIGYSGPTVCASGTTCQVLNPYASQCL

SEQ ID NO: 748 - protein, 72 aa, Artificial Sequence
  Chain A, Three-Dimensional Structures Of Three Engineered Cellulose-Binding Domains Of Cellobiohydrolase I From Trichoderma Reesei, Nmr, 18 Structures 36 aa protein 1AZJ_A GI:15783158
TQSHYGQCGGIGYSGPTVCASGTTCQVLNPYASQCLTQSHYGQCGGIGYSGPTVCASGTTCQVLNPAYSQCL

SEQ ID NO: 749 - protein, 36 aa, Artificial Sequence
  Chain A, Three-Dimensional Structures Of Three Engineered Cellulose-Binding Domains Of Cellobiohydrolase I From Trichoderma Reesei, Nmr, 14 Structures 36 aa protein 1AZH_A GI:15783156
TQSHAGQCGGIGYSGPTVCASGTTCQVLNPYYSQCL

SEQ ID NO: 750 - protein, 36 aa, Artificial Sequence; identical to SEQ ID NO: 749
  Chain A, Three-Dimensional Structures Of Three Engineered Cellulose-Binding Domains Of Cellobiohydrolase I From Trichoderma Reesei, Nmr, 23 Structures 36 aa protein 1AZ6_A GI:15783153

SEQ ID NO: 751 - protein, 471 aa, Artificial Sequence
  cellobiohydrolase II [Trichoderma reesei] 471 aa protein AAA3421.1 GI:17541
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 752 - protein, 38 aa, Artificial Sequence
  Cellobiohydrolase II core protein, CBH II cp=3.2.1.91 [T. reesei, Peptide Partial, 38 aa]
  VARIANT 6, 23, 26, 27, 32: Xaa = Any Amino Acid
GSASYXGNPFVGVSPWANAYYAXEVXXLAIPXLTGAMA

SEQ ID NO: 753 - protein, 36 aa, Artificial Sequence; identical to SEQ ID NO: 746
  C-Terminal Domain Of Cellobiohydrolase I  1CBH_A GI:15783535

SEQ ID NO: 754 - protein, 471 aa, Artificial Sequence
  cellobiohydrolase II [Trichoderma reesei] 471 aa protein AAG3998.1 GI:11692747
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGRLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 755 - protein, 434 aa, Artificial Sequence
  Chain A, Cellobiohydrolase Cel7a (E223s, A224h, L225v, T226a, D262g) Mutant 1EGN_A  GI:14277711
  VARIANT 1: Xaa = Any Amino Acid
XSACTLQSETHPPLTWQKCSSGGTCTQQTGSVVIDANWRWTHATNSSTNCYDGNTWSSTLCPDNETCAKNCCLDGAAYASTYGVTTSGNSLSIDFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISSHVAPHPCTTVGQEICEGDGCGGTYSDNRYGGTCDPDGCGWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 756 - protein, 426 aa, Artificial Sequence
  Chain B, Cellobiohydrolase Cel7a With Loop Deletion 245-252 And Bound Non- Hydrolysable Cellotetraose 426 aa protein 1Q2E_B GI:39654596
  VARIANT 1: Xaa = Any Amino Acid
XSACTLQSETHPPLTWQKCSSGGTCTQQTGSVVIDANWRWTHATNSSTNCYDGNTWSSTLCPDNETCAKNCCLDGAAYASTYGVTTSGNSLSIDFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 757 - protein, 426 aa, Artificial Sequence; identical to SEQ ID NO: 756
  Chain A, Cellobiohydrolase Cel7a With Loop Deletion 245-252 And Bound Non- Hydrolysable Cellotetraose 426 aa protein 1Q2E_A GI:39654595
  VARIANT 1: Xaa = Any Amino Acid

SEQ ID NO: 758 - protein, 434 aa, Artificial Sequence
  Chain A, Cellobiohydrolase Cel7a With Disulphide Bridge Added Across Exo-Loop By Mutations D241c And D249c 434 aa protein 1Q2B_A GI:39654594
  VARIANT 1: Xaa = Any Amino Acid
XSACTLQSETHPPLTWQKCSSGGTCTQQTGSVVIDANWRWTHATNSSTNCYDGNTWSSTLCPDNETCAKNCCLDGAAYASTYGVTTSGNSLSIDFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGCGCGGTYSCNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 759 - protein, 438 aa, Artificial Sequence; identical to SEQ ID NO: 452
  glycoside hydrolase family 5 [Trichoderma reesei QM6a] 438 aa protein XP_6969897.1 GI:589115749

SEQ ID NO: 760 - protein, 418 aa, Artificial Sequence; identical to SEQ ID NO: 447
  glycoside hydrolase family 5 [Trichoderma reesei QM6a] 418 aa protein EGR512.1 GI:3452785

SEQ ID NO: 761 - protein, 344 aa, Artificial Sequence; identical to SEQ ID NO: 459
  glycoside hydrolase family 61 [Trichoderma reesei QM6a] 344 aa protein EGR52697.1 GI:34522464

SEQ ID NO: 762 - protein, 242 aa, Artificial Sequence; identical to SEQ ID NO: 451
  endo-1,4-beta-glucanase V [Trichoderma reesei RUT C-3] 242 aa protein ETR998.1 GI:572276454

SEQ ID NO: 763 - protein, 249 aa, Artificial Sequence; identical to SEQ ID NO: 460
  Chain A, The Structure Of A Glycoside Hydrolase Family 61 Member, Cel61b From The Hypocrea Jecorina 249 aa protein 2VTC_A GI:19844312

SEQ ID NO: 764 - protein, 249 aa, Artificial Sequence; identical to SEQ ID NO: 460
  Chain B, The Structure Of A Glycoside Hydrolase Family 61 Member, Cel61b From The Hypocrea Jecorina 249 aa protein 2VTC_B GI:198443121

SEQ ID NO: 765 - protein, 438 aa, Artificial Sequence; identical to SEQ ID NO: 452
  endoglucanase VIII [Trichoderma reesei RUT C-3] 438 aa protein ETR9685.1 GI:572273122

SEQ ID NO: 766 - protein, 378 aa, Artificial Sequence
  putative endoglucanase [Trichoderma reesei RUT C-3] 378 aa protein ETS3449.1 GI:57228352
MKLWIGLLLLGLACRASAHTTFTTLFIDKKNQGDGTCVRMPYDDKTATNPVKPITSSDMACGRNGGDPVPFICSAKKGSLLTFEFRLWPDAQQPGSIDPGHLGPCAVYLKKVDNMFSDSAAGGGWFKIWEDGYDSKTQKWCVDRLVKNNGLLSVRLPRGLPAGYYIVRPEILALHWAAHRDDPQFYLGCAQIFVDSDVRGPLEIPRRQQATIPGYVNAKTPGLTFDIYQDKLPPYPMPGPKVYIPPAKGNKPNQDLNAGRLVQTDGLIPKDCLIKKANWCGRPVEPYSSARMCWRAVNDCYAQSKKCRESSPPIGLTNCDRWSDHCGKMDALCEQEKYKGPPKFTEKEYVVPAPGKLPEMWNDIFERLEQNGTSTKFF

SEQ ID NO: 767 - protein, 249 aa, Artificial Sequence; identical to SEQ ID NO: 448
  endoglucanase VII [Trichoderma reesei RUT C-3] 249 aa protein ETS3833.1 GI:57228773

SEQ ID NO: 768 - protein, 418 aa, Artificial Sequence; identical to SEQ ID NO: 447
  endoglucanase III [Trichoderma reesei RUT C-3] 418 aa protein ETS4885.1 GI:572281861

SEQ ID NO: 769 - protein, 234 aa, Artificial Sequence
  putative endoglucanase [Trichoderma reesei RUT C-3] 234 aa protein ETS538.1 GI:572282294
MKLLSIASLLSLVATAQAHMEVSWPPVFRSKYNPRVPGNLINYDMTSPLNADGSNYPCKGYQVDVGRPEGAPGVTWRAGGTYNLTVAGSATHSGGSCQASLSYDRGRTWVVVHSWIGGCPLTPTWDFTLPNDTPPGEALFAWTWFNRIGNREMYMNCGAVTIRPSGRAARSPADSIYNRPAQFVANVNNGCATLEGADVLFPSPGPDTDFDSDRTAAPVGKCGASSRRTRPVRA

SEQ ID NO: 770 - protein, 242 aa, Artificial Sequence; identical to SEQ ID NO: 451
  Full=Endoglucanase-5 P43317.1 GI:117136

SEQ ID NO: 771 - protein, 434 aa, Artificial Sequence
  Chain A, Active-Site Mutant E212q Determined At Ph 6. With No Ligand Bound In The Active Site 2CEL_A GI:1942104
  VARIANT 1: Xaa = Any Amino Acid
XSACTLQSETHPPLTWQKCSSGGTCTQQTGSVVIDANWRWTHATNSSTNCYDGNTWSSTLCPDNETCAKNCCLDGAAYASTYGVTTSGNSLSIDFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSQMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 772 - protein, 434 aa, Artificial Sequence; identical to SEQ ID NO: 771
  Chain B, Active-Site Mutant E212q Determined At Ph 6. With No Ligand Bound In The Active Site 434 aa protein 2CEL_B GI:194215
  VARIANT 1: Xaa = Any Amino Acid

SEQ ID NO: 773 - protein, 434 aa, Artificial Sequence; identical to SEQ ID NO: 771
  Chain A, Active-Site Mutant E212q Determined At Ph 6. With Cellobiose Bound In The Active Site 434 aa protein 3CEL_A GI:157836779
  VARIANT 1: Xaa = Any Amino Acid

SEQ ID NO: 774 - protein, 434 aa, Artificial Sequence
  Chain A, Active-site Mutant D214n Determined At Ph 6. With No Ligand Bound In The Active Site 434 aa protein 4CEL_A GI:1941941
  VARIANT 1: Xaa = Any Amino Acid
XSACTLQSETHPPLTWQKCSSGGTCTQQTGSVVIDANWRWTHATNSSTNCYDGNTWSSTLCPDNETCAKNCCLDGAAYASTYGVTTSGNSLSIDFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMNIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 775 - protein, 434 aa, Artificial Sequence; identical to SEQ ID NO: 774
  Chain B, Active-site Mutant D214n Determined At Ph 6. With No Ligand Bound In The Active Site 434 aa protein 4CEL_B GI:1941942
  VARIANT 1: Xaa = Any Amino Acid

SEQ ID NO: 776 - protein, 344 aa, Artificial Sequence; identical to SEQ ID NO: 459
  Cellulase IV O1445.1 GI:21263647

SEQ ID NO: 777 - protein, 459 aa, Artificial Sequence; identical to SEQ ID NO: 450
  endoglucanase I precursor [Trichoderma reesei RUT C-3] 459 aa protein ETS775.1 GI:57228411

SEQ ID NO: 778 - protein, 434 aa, Artificial Sequence
  Chain A, Cbh1 (E217q) In Complex With Cellohexaose And Cellobiose 434 aa protein 7CEL_A GI:157837135
  VARIANT 1: Xaa = Any Amino Acid
XSACTLQSETHPPLTWQKCSSGGTCTQQTGSVVIDANWRWTHATNSSTNCYDGNTWSSTLCPDNETCAKNCCLDGAAYASTYGVTTSGNSLSIDFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWQANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 779 - protein, 434 aa, Artificial Sequence; identical to SEQ ID NO: 771
  Chain A, Cbh1 (E212q) Cellotetraose Complex 434 aa protein 5CEL_A GI:1578372
  VARIANT 1: Xaa = Any Amino Acid

SEQ ID NO: 780 - protein, 434 aa, Artificial Sequence; identical to SEQ ID NO: 771
  Chain A, Cbh1 (E212q) Cellopentaose Complex 434 aa protein 6CEL_A GI:15783787
  VARIANT 1: Xaa = Any Amino Acid

SEQ ID NO: 781 - protein, 418 aa, Artificial Sequence
  RecName: Full=Endoglucanase EG-II; Short=EGLII; AltName: Full=Cellulase; AltName: Full=Endo-1,4-beta-glucanase; Flags: Precursor 418 aa protein P7982.1 GI:121794
MNKSVAPLLLAASILYGGAVAQQTVWGQCGGIGWSGPTNCAPGSACSTLNPYYAQCIPGATTITTSTRPPSGPTTTTRATSTSSSTPPTSSGVRFAGVNIAGFDFGCTTDGTCVTSKVYPPLKNFTGSNNYPDGIGQMQHFVNEDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTSSGNSWTDTSLVSSCLARK

SEQ ID NO: 782 - protein, 459 aa, Artificial Sequence; identical to SEQ ID NO: 450
  RecName: Full=Endoglucanase EG-1; AltName: Full=Cellulase; AltName: Full=Endo-1,4-beta-glucanase; Flags: Precursor 459 aa protein P7981.1 GI:121788

SEQ ID NO: 783 - protein, 242 aa, Artificial Sequence; identical to SEQ ID NO: 451
  endo-1,4-beta-glucanase V (EGV) [Trichoderma reesei] 242 aa protein CAA83846.1 GI:485864

SEQ ID NO: 784 - protein, 234 aa, Artificial Sequence
  beta-1,4-glucanase [Trichoderma reesei] 234 aa protein ABV71388.1 GI:15777972
MKFLQVLPALIPAALAQTSCDQWATFTGNGYTVSNNLWGASAGSGFGCVTAVSLSGGASWHADWQWSGGQNNVKSYQNSQIAIPQKRTVNSISSMPTTASWSYSGSNIRANVAYDLFTAANPNHVTYSGDYELMIWLGKYGDIGPIGSSQGTVNVGGQSWTLYYGYNGAMQVYSFVAQTNTTNYSGDVKNFFNYLRDNKGYNAAGQYVLSYQFGTEPFTGSGTLNVASWTASIN

SEQ ID NO: 785 - protein, 471 aa, Artificial Sequence
  cellbiohydrolase II [Trichoderma reesei] 471 aa protein ADC83999.1 GI:289152138
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVTGTGFGIRPSANTGDSLLDSFVWVKPGGECDGTSDSSAPRFDSHCALPDALQPAPQAGAWFQAYFVQLLTNANPSFL

SEQ ID NO: 786 - protein, 234 aa, Artificial Sequence; identical to SEQ ID NO: 784
  endo-beta-1,4-glucanase [Trichoderma reesei] 234 aa protein BAA214.1 GI:2116583

SEQ ID NO: 787 - protein, 340 aa, Artificial Sequence
  Chain A, Crystal Structure Of Cel5a (Eg2) From Hypocrea Jecorina (Trichoderma Reesei) 34 aa protein 3QR3_A GI:39981273
MGVRFAGVNIAGFDFGCTTDGTCVTSKVYPPLKNFTGSNNYPDGIGQMQHFVNEDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTSSGNSWTDTSLVSSCLARKGGSGSGHHHHHH

SEQ ID NO: 788 - protein, 340 aa, Artificial Sequence; identical to SEQ ID NO: 787
  Chain B, Crystal Structure Of Cel5a (Eg2) From Hypocrea Jecorina (Trichoderma Reesei) 34 aa protein 3QR3_B GI:39981274

SEQ ID NO: 789 - protein, 838 aa, Artificial Sequence
  Cel74a [Trichoderma reesei] 838 aa protein AAP57752.1 GI:317471
MKVSRVLALVLGAVIPAHAAFSWKNVKLGGGGGFVPGIIFHPKTKGVAYARTDIGGLYRLNADDSWTAVTDGIADNAGWHNWGIDAVALDPQDDQKVYAAVGMYTNSWDPSNGAIIRSSDRGATWSFTNLPFKVGGNMPGRGAGERLAVDPANSNIIYFGARSGNGLWKSTDGGVTFSKVSSFTATGTYIPDPSDSNGYNSDKQGLMWVTFDSTSSTTGGATSRIFVGTADNITASVYVSTNAGSTWSAVPGQPGKYFPHKAKLQPAEKALYLTYSDGTGPYDGTLGSVWRYDIAGGTWKDITPVSGSDLYFGFGGLGLDLQKPGTLVVASLNSWWPDAQLFRSTDSGTTWSPIWAWASYPTETYYYSISTPKAPWIKNNFIDVTSESPSDGLIKRLGWMIESLEIDPTDSNHWLYGTGMTIFGGHDLTNWDTRHNVSIQSLADGIEEFSVQDLASAPGGSELLAAVGDDNGFTFASRNDLGTSPQTVWATPTWATSTSVDYAGNSVKSVVRVGNTAGTQQVAISSDGGATWSIDYAADTSMNGGTVAYSADGDTILWSTASSGVQRSQFQGSFASVSSLPAGAVIASDKKTNSVFYAGSGSTFYVSKDTGSSFTRGPKLGSAGTIRDIAAHPTTAGTLYVSTDVGIFRSTDSGTTFGQVSTALTNTYQIALGVGSGSNWNLYAFGTGPSGARLYASGDSGASWTDIQGSQGFGSIDSTKVAGSGSTAGQVYVGTNGRGVFYAQGTVGGGTGGTSSSTKQSSSSTSSASSSTTLRSSVVSTTRASTVTSSRTSSAAGPTGSGVAGHYAQCGGIGWTGPTQCVAPYVCQKQNDYYYQCV

SEQ ID NO: 790 - protein, 249 aa, Artificial Sequence; identical to SEQ ID NO: 460
  Cel61b [Trichoderma reesei] 249 aa protein AAP57753.1 GI:31747162

SEQ ID NO: 791 - protein, 438 aa, Artificial Sequence; identical to SEQ ID NO: 452
  Cel5b [Trichoderma reesei] 438 aa protein AAP57754.1 GI:31747164

SEQ ID NO: 792 - protein, 459 aa, Artificial Sequence; identical to SEQ ID NO: 450
  endoglucanase I 459 aa protein 132152A GI:22541

SEQ ID NO: 793 - protein, 344 aa, Artificial Sequence; identical to SEQ ID NO: 459
  endoglucanase IV [Trichoderma reesei] 344 aa protein CAA71999.1 GI:2315274

SEQ ID NO: 794 - protein, 459 aa, Artificial Sequence
  endoglucanase I [Trichoderma reesei] 459 aa protein ADM8177.1 GI:3329711
MAPSVTLPLTTAILAIARLVAAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFSPYGSGYKSYYGPGDTVDTSKTFTIITQFNTDNGSPSGNLVSITRKYQQNGVDVPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQCL

SEQ ID NO: 795 - protein, 418 aa, Artificial Sequence; identical to SEQ ID NO: 781
  endoglucanase II precursor [Trichoderma reesei] 418 aa protein AAA34213.1 GI:17549

SEQ ID NO: 796 - protein, 418 aa, Artificial Sequence
  endoglucanase II [Trichoderma reesei] 418 aa protein ABA64553.1 GI:77176916
MNKSVAPLLLAASILYGGAVAQQTVWGQCGGIGWSGPTNCAPGSACSTLNPYYAQCIPGATTITTSTRPPSGPTTTTRATSTSSSTPPTSSGVRFAGVNIAGFDFGCTTDGTCVTSKVYPPLKNFTGSNNYPDGIGQMQHFVNEDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTGSGNSWTDTSLVSSCLARK

SEQ ID NO: 797 - protein, 218 aa, Artificial Sequence
  Chain A, The X-Ray Crystal Structure Of The Trichoderma Reesei Family 12 Endoglucanase 3, Cel12a, At 1.9 A Resolution 218 aa protein 1H8V_A GI:14278359
  VARIANT 1: Xaa = Any Amino Acid
XTSCDQWATFTGNGYTVSNNLWGASAGSGFGCVTAVSLSGGASWHADWQWSGGQNNVKSYQNSQIAIPQKRTVNSISSMPTTASWSYSGSNIRANVAYDLFTAANPNHVTYSGDYELMIWLGKYGDIGPIGSSQGTVNVGGQSWTLYYGYNGAMQVYSFVAQTNTTNYSGDVKNFFNYLRDNKGYNAAGQYVLSYQFGTEPFTGSGTLNVASWTASIN

SEQ ID NO: 798 - protein, 218 aa, Artificial Sequence; identical to SEQ ID NO: 797
  Chain B, The X-Ray Crystal Structure Of The Trichoderma Reesei Family 12 Endoglucanase 3, Cel12a, At 1.9 A Resolution 218 aa protein 1H8V_B GI:142783
  VARIANT 1: Xaa = Any Amino Acid

SEQ ID NO: 799 - protein, 218 aa, Artificial Sequence; identical to SEQ ID NO: 797
  Chain C, The X-Ray Crystal Structure Of The Trichoderma Reesei Family 12 Endoglucanase 3, Cel12a, At 1.9 A  Resolution 218 aa protein 1H8V_C GI:14278361
  VARIANT 1: Xaa = Any Amino Acid

SEQ ID NO: 800 - protein, 218 aa, Artificial Sequence; identical to SEQ ID NO: 797
  Chain D, The X-Ray Crystal Structure Of The Trichoderma Reesei Family 12 Endoglucanase 3, Cel12a, At 1.9 A Resolution 218 aa protein 1H8V_D GI:14278362
  VARIANT 1: Xaa = Any Amino Acid

SEQ ID NO: 801 - protein, 218 aa, Artificial Sequence; identical to SEQ ID NO: 797
  Chain E, The X-Ray Crystal Structure Of The Trichoderma Reesei Family 12 Endoglucanase 3, Cel12a, At 1.9 A Resolution 218 aa protein 1H8V_E GI:14278363
  VARIANT 1: Xaa = Any Amino Acid

SEQ ID NO: 802 - protein, 218 aa, Artificial Sequence; identical to SEQ ID NO: 797
  Chain F, The X-Ray Crystal Structure Of The Trichoderma Reesei Family 12 Endoglucanase 3, Cel12a, At 1.9 A Resolution 218 aa protein 1H8V_F GI:14278364
  VARIANT 1: Xaa = Any Amino Acid

SEQ ID NO: 803 - protein, 459 aa, Artificial Sequence; identical to SEQ ID NO: 450
  endoglucanase I precursor [Trichoderma reesei] 459 aa protein AAA34212.1 GI:17547

SEQ ID NO: 804 - protein, 38 aa, Artificial Sequence
  Chain A, Solution Structure Of The Cellulose- binding Domain Of Endoglucanase I From Trichoderma Reesei And Its Interaction With Cello-oligo- saccharides 38 aa protein 4BMF_A GI:5743
SCTQTHWGQCGGIGYSGCKTCTSGTTCQYSNDYYSQCL

SEQ ID NO: 805 - protein, 371 aa, Artificial Sequence
  Chain A, Endoglucanase I From Trichoderma Reesei 371 aa protein 1EG1_A GI:239236
  VARIANT 1: Xaa = Any Amino Acid
XQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVSITRKYQQNGVDIPSAQPGGDTISSCPSASAYGGLATMGKALSSGMVLVFSIWNDNSQYMNWLDSGNAGPCSSTEGNPSNILANNPNTHVVFSNIRWGDIGSTT

SEQ ID NO: 806 - protein, 371 aa, Artificial Sequence; identical to SEQ ID NO: 805
  Chain C, Endoglucanase I From Trichoderma Reesei 371 aa protein 1EG1_C GI:239237
  VARIANT 1: Xaa = Any Amino Acid

SEQ ID NO: 807 - protein, 764 aa, Artificial Sequence
  endoglucanase [Trichoderma reesei RUT C-3] 764 aa protein ETS6856.1 GI:572283882
MRSFSLLGSLSLLTSLSWALPTEGVISKLEGRQSGSSWFLPNIDHTTGAVRGYVPNLFNSAGQQNFTYPVYKTVASGDSAGFVNALYSDGPSGGQRDNCYLAGEPRVIYLPPGTYTVSSTIFFDTDTVIIGDAANPPTIKAAAGFNGDYLIVGGQGDGDSHPCGGSGGETHFSVMIKNVILDTTANAGSSGFTALSWAVAQNCALVNVKINMPQGVHTGMLVSGGSTISISDVSFNFGNIGLHWNGHQQGQIKGMTFTDCTNGIFIDSGFTISIFAPTCNTVGRCIVLNSGNAWVAVIDGQSINSGDFFTSNVGFPNFMLENISKDTTNSNMVVVGGNVKVGGSTSLGTYVYGNTRGANPVYQTNPTSQPVNRPAALAPGGRYPVINAPQYADKTVANVVNLKDPNQNGGHTLQGDGFTDDTAALQGALNTAASQGKIAYLPFGIYIVKSTITIPPGTELYGEAWSTISGSGSAFSSETNPTPVVQIGATPGQKGVAHVQDIRFTVNEALPGAILLRINMAGNNPGDVAVFNSLNTIGGTRDTSISCSSESNCRAAYLGLHLAAGSSAYIDNFWSWVADHATDQSGKGTRTAVKGGVLVEATAGTWLTGLGSEHNWLYQLSFHNAANVFISLFQSETNYNQGNNGAPLPGTPFDATSIDPNFSWCSGGDTVCRMGLAQYYTGSNSNIFHYAAGSWNFIGLTKVNQGLMNFIQSTISNAHLYGFTSGPNTGETMRLPNGVEFGNGGNDGYGGSWGTLIANIASQS

SEQ ID NO: 808 - protein, 242 aa, Artificial Sequence; identical to SEQ ID NO: 451
  endoglucanase, partial [Trichoderma reesei] 242 aa protein AHK2346.1 GI:58829453

SEQ ID NO: 809 - protein, 434 aa, Artificial Sequence; identical to SEQ ID NO: 771
  Chain A, Hypocrea Jecorina Cel7a E212q Mutant In Complex With P-nitrophenyl Cellobioside 434 aa protein 4UWT_A GI:922664681
  VARIANT 1: Xaa = Any Amino Acid

SEQ ID NO: 810 - protein, 434 aa, Artificial Sequence
  Chain A, O-nitrophenyl Cellobioside As An Active Site Probe For Family 7 Cellobiohydrolases 434 aa protein 4VZ_A GI:931139719
  VARIANT 1: Xaa = Any Amino Acid
XSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQDGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 811 - protein, 434 aa, Artificial Sequence
  Chain A, Hypocrea Jecorina Cel7a (wild Type) Soaked With Xylopentaose 434 aa protein 4D5Q_A GI:783282859
  VARIANT 1: Xaa = Any Amino Acid
XSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWQANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSG

SEQ ID NO: 812 - protein, 434 aa, Artificial Sequence; identical to SEQ ID NO: 743
  Chain A, Cbh1 In Complex With S-propranolol 434 aa protein 1DY4_A GI:1284415
  VARIANT 1: Xaa = Any Amino Acid

SEQ ID NO: 813 - protein, 471 aa, Artificial Sequence; identical to SEQ ID NO: 751
  glycoside hydrolase family 6 [Trichoderma reesei QM6a] 471 aa protein XP_696258.1 GI:58911115

SEQ ID NO: 814 - protein, 514 aa, Artificial Sequence
  glycoside hydrolase family 7 [Trichoderma reesei QM6a] 514 aa protein XP_6969224.1 GI:58911443
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSSPGPTQSHYGQCGGIGYSGPTVCASGTTCQVLNPYYSQCL

SEQ ID NO: 815 - protein, 514 aa, Artificial Sequence; identical to SEQ ID NO: 814
  glycoside hydrolase family 7 [Trichoderma reesei QM6a] 514 aa protein EGR44817.1 GI:34514556

SEQ ID NO: 816 - protein, 471 aa, Artificial Sequence; identical to SEQ ID NO: 751
  glycoside hydrolase family 6 [Trichoderma reesei QM6a] 471 aa protein EGR5117.1 GI:3452782

SEQ ID NO: 817 - protein, 434 aa, Artificial Sequence; identical to SEQ ID NO: 771
  Chain A, Hypocrea Jecorina Cellobiohydrolase Cel7a E212q Soaked With Xylotriose 434 aa protein 4D5I_A GI:783282849
  VARIANT 1: Xaa = Any Amino Acid

SEQ ID NO: 818 - protein, 434 aa, Artificial Sequence; identical to SEQ ID NO: 778
  Chain A, Hypocrea Jecorina Cellobiohydrolase Cel7a E217q Soaked With Xylopentaose 434 aa protein 4D5P_A GI:783282856
  VARIANT 1: Xaa = Any Amino Acid

SEQ ID NO: 819 - protein, 434 aa, Artificial Sequence; identical to SEQ ID NO: 743
  Chain A, Hypocrea Jecorina Cel7a In Complex With (R)-Dihydroxy- Phenanthrenolol 434 aa protein 2V3I_A GI:19356563
  VARIANT 1: Xaa = Any Amino Acid

SEQ ID NO: 820 - protein, 434 aa, Artificial Sequence; identical to SEQ ID NO: 743
  Chain A, Hypocrea Jecorina Cel7a In Complex With (S)-Dihydroxy- Phenanthrenolol 434 aa protein 2V3R_A GI:19356564
  VARIANT 1: Xaa = Any Amino Acid

SEQ ID NO: 821 - protein, 434 aa, Artificial Sequence; identical to SEQ ID NO: 778
  Chain A, Michaelis Complex Of Hypocrea Jecorina Cel7a E217q Mutant With Cellononaose Spanning The Active Site 434 aa protein 4C4C_A GI:57215318
  VARIANT 1: Xaa = Any Amino Acid

SEQ ID NO: 822 - protein, 434 aa, Artificial Sequence; identical to SEQ ID NO: 778
  Chain A, Covalent Glycosyl-enzyme Intermediate Of Hypocrea Jecorina Cel7a E217q Mutant Trapped Using Dnp-2-deoxy-2-fluoro-cellotrioside 434 aa protein 4C4D_A GI:572153181
  VARIANT 1: Xaa = Any Amino Acid

SEQ ID NO: 823 - protein, 365 aa, Artificial Sequence
  Chain A, Cel6a D175a Mutant 365 aa protein 1HGW_A GI:1865599
SGTATYSGNPFVGVTPWANAYYASEVSSLAIPSLTGAMATAAAAVAKVPSFMWLDTLDKTPLMEQTLADIRTANKNGGNYAGQFVVYDLPDRACAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 824 - protein, 365 aa, Artificial Sequence; identical to SEQ ID NO: 823
  Chain B, Cel6a D175a Mutant 365 aa protein 1HGW_B GI:1865591

SEQ ID NO: 825 - protein, 365 aa, Artificial Sequence
  Chain A, Cel6a D221a Mutant 365 aa protein 1HGY_A GI:18655911
SGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPASLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 826 - protein, 365 aa, Artificial Sequence; identical to SEQ ID NO: 825
  Chain B, Cel6a D221a Mutant 365 aa protein 1HGY_B GI:18655912

SEQ ID NO: 827 - protein, 490 aa, Artificial Sequence
  cellobiohydrolase,beta glucan 49 aa protein 13195A GI:223874
  VARIANT 348, 349: Xaa = Any Amino Acid
ESACTLQSETHPPLTWQKCSSGGTCTQQTGSVVIDANWRWTHATNSSTNCYDGNTWSSTLCPDNETCAKNCCLDGAAYTSAYSSZPGGGGGVVIFFKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQDGVTFQQPNAELGSYSGNELNDDYCTAEEAEFGGSSFSDKGGLTQFXXATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTTTTSSSZPPPGAHRRYGQCGGIGYSGPTVCASGTTCQVLNPYYSQCL

SEQ ID NO: 828 - protein, 365 aa, Artificial Sequence
  Chain A, Cel6a (y169f) With A Non-hydrolysable Cellotetraose 365 aa protein 1QJW_A GI:6137482
SGTATYSGNPFVGVTPWANAYYASEVSSLAIPSLTGAMATAAAAVAKVPSFMWLDTLDKTPLMEQTLADIRTANKNGGNYAGQFVVFDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 829 - protein, 365 aa, Artificial Sequence; identical to SEQ ID NO: 828
  Chain B, Cel6a (y169f) With A Non-hydrolysable Cellotetraose 365 aa protein 1QJW_B GI:6137483

SEQ ID NO: 830 - protein, 363 aa, Artificial Sequence
  Chain A, Cel6a In Complex With M-iodobenzyl Beta-d-glucopyranosyl- Beta(1,4)-d-xylopyranoside 363 aa protein 1QK_A GI:6137484
TATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGPLLANHGWSNAFFITDQGRSGKQPTGQQQWGDWCNVIGTGFGIRPSANTGDSLLDSFVWVKPGGECDGTSDSSAPRFDSHCALPDALQPAPQAGAWFQAYFVQLLTNANPSFL

SEQ ID NO: 831 - protein, 363 aa, Artificial Sequence; identical to SEQ ID NO: 830
  Chain B, Cel6a In Complex With M-iodobenzyl Beta-d-glucopyranosyl- Beta(1,4)-d-xylopyranoside 363 aa protein 1QK_B GI:6137485

SEQ ID NO: 832 - protein, 363 aa, Artificial Sequence; identical to SEQ ID NO: 830
  Chain A, Wild Type Cel6a With A Non-hydrolysable Cellotetraose 363 aa protein 1QK2_A GI:6137486

SEQ ID NO: 833 - protein, 363 aa, Artificial Sequence; identical to SEQ ID NO: 830
  Chain B, Wild Type Cel6a With A Non-hydrolysable Cellotetraose 363 aa protein 1QK2_B GI:6137487

SEQ ID NO: 834 - protein, 471 aa, Artificial Sequence; identical to SEQ ID NO: 751
  RecName:Full=Exoglucanase 2;AltName:Full=1,4-beta- cellobiohydrolase;AltName:Full=Exocellobiohydrolas e II;Short=CBHII;AltName:Full=Exoglucanase II; Flags:Precursor 471 aa protein P7987.1 GI:121855

SEQ ID NO: 835 - protein, 513 aa, Artificial Sequence
  RecName:Full=Exoglucanase 1;AltName:Full=1,4-beta- cellobiohydrolase;AltName:Full=Exocellobiohydrolas e I; Short=CBHI;AltName:Full=Exoglucanase I; Flags:Precursor 513 aa protein P62694.1 GI:542144
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNRGTTTTRRPATTTGSSPGPTQSHYGQCGGIGYSGPTVCASGTTCQVLNPYYSQCL

SEQ ID NO: 836 - protein, 471 aa, Artificial Sequence; identical to SEQ ID NO: 751
  unnamed protein product [Trichoderma reesei] 471 aa protein CAV28333.1 GI:21829938

SEQ ID NO: 837 - protein, 471 aa, Artificial Sequence; identical to SEQ ID NO: 751
  cellobiohydrolase II 471 aa protein 134188A GI:225475

SEQ ID NO: 838 - protein, 471 aa, Artificial Sequence
  unnamed [Trichoderma reesei] 471 aa protein AAA72922.1 GI:17543
MIVGILTTLATLATLAASVPLEERQACSSVWGQCGGQNWSGPTCCASGSTCVYSNDYYSQCLPGAASSSSSTRAASTTSRVSPTTSRSSSATPPPGSTTTRVPPVGSGTATYSGNPFVGVTPWANAYYASEVSSLAIPSLTGAMATAAAAVAKVPSFMWLDTLDKTPLMEQTLADIRTANKNGGNYAGQFVVYDLPDRDCAALASNGEYSIADGGVAKYKNYIDTIRQIVVEYSDIRTLLVIEPDSLANLVTNLGTPKCANAQSAYLECINYAVTQLNLPNVAMYLDAGHAGWLGWPANQDPAAQLFANVYKNASSPRALRGLATNVANYNGWNITSPPSYTQGNAVYNEKLYIHAIGRLLANHGWSNAFFITDQGRSGKQPTGQQQWGDWCNVIGTGFGIRPSANTGDSLLDSFVWVKPGGECDGTSDSSAPRFDSHCALPDALQPAAQAGAWFQAYFVQLLTNANPSFL

SEQ ID NO: 839 - protein, 434 aa, Artificial Sequence; identical to SEQ ID NO: 778
  Chain A, Hypocrea Jecorina Cellobiohydrolase Cel7a E217q Soaked With Xylotriose 434 aa protein 4D5J_A GI:783282851
  VARIANT 1: Xaa = Any Amino Acid

SEQ ID NO: 840 - protein, 434 aa, Artificial Sequence; identical to SEQ ID NO: 771
  Chain A, Hypocrea Jecorina Cellobiohydrolase Cel7a E212q Soaked With Xylopentaose 434 aa protein 4D5O_A GI:783282853
  VARIANT 1: Xaa = Any Amino Acid

SEQ ID NO: 841 - protein, 434 aa, Artificial Sequence; identical to SEQ ID NO: 778
  Chain A, Hypocrea Jecorina Cellobiohydrolase Cel7a E217q Soaked With Xylotetraose 434 aa protein 4D5V_A GI:783282861
  VARIANT 1: Xaa = Any Amino Acid

SEQ ID NO: 842 - protein, 365 aa, Artificial Sequence; identical to SEQ ID NO: 828
  Chain A, Cellobiohydrolase Ii, Catalytic Domain, Mutant Y169f 365 aa protein 1CB2_A GI:182776

SEQ ID NO: 843 - protein, 365 aa, Artificial Sequence; identical to SEQ ID NO: 828
  Chain B, Cellobiohydrolase Ii, Catalytic Domain, Mutant Y169f 365 aa protein 1CB2_B GI:182777

SEQ ID NO: 844 - skipped

SEQ ID NO: 845 - DNA, 2469 bp, Artificial Sequence
  SS2c-G1 Mating pheromone a-factor
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgcaaccatctaccgctaccgccgctccaaaagaaaagaccagcagtgaaaagaaggacaactatattatcaaaggtgtcttctgggacccagcatgtgttattgcttag

SEQ ID NO: 846 - protein, 822 aa, Artificial Sequence
  SS2c-G10 Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMQPSTATAAPKEKTSSEKKDNYIIKGVFWDPACVIA

SEQ ID NO: 847 - skipped

SEQ ID NO: 848 - DNA, 2469 bp, Artificial Sequence; identical to SEQ ID NO: 845
  SS2c-G10 Full gene NT Seq STEP 1

SEQ ID NO: 849 - protein, 822 aa, Artificial Sequence; identical to SEQ ID NO: 846
  SS2c-G10 Full Gene AA seq

SEQ ID NO: 850 - DNA, 3042 bp, Artificial Sequence
  SS2e-A7b Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgtctgcatctactacaagtttagaggaatatcaaaaaactttccttgaactgggattagaatgcaaagcactaagatttgggtcattcaagctgaattcaggcaggcagtcgccatattttttcaatcttagtttgttcaattctggaaagctgttggcaaaccttgccaccgcgtatgcaactgctatcattcaatcggagcttaaattcgatgttattttcggacctgcttacaaagggatccctttggctgctattgtatgcgttaaactagcagaaatcgggggcactaaatttcaaggtattcaatatgcttttaatagaaagaaagttaaagaccacggcgaaggtggtattattgttggagcatcgcttgaagacaagagggtgttgattatcgacgatgtcatgactgcaggaactgcaatcaatgaagcatttgagataatcagtattgctcaaggtagggtagtgggttgtattgttgctttagataggcaagaagtgattcatgaatctgatccggaaagaacaagtgctacccaatctgtttcaaagagatacaacgttcctgtgctaagtattgtatcactgactcaagtggtacaatttatgggaaatagactatcaccagagcaaaaatcagcgattgaaaactaccgtaaggcctatggtatatga

SEQ ID NO: 851 - protein, 1013 aa, Artificial Sequence
  SS2e-A7b Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMSASTTSLEEYQKTFLELGLECKALRFGSFKLNSGRQSPYFFNLSLFNSGKLLANLATAYATAIIQSELKFDVIFGPAYKGIPLAAIVCVKLAEIGGTKFQGIQYAFNRKKVKDHGEGGIIVGASLEDKRVLIIDDVMTAGTAINEAFEIISIAQGRVVGCIVALDRQEVIHESDPERTSATQSVSKRYNVPVLSIVSLTQVVQFMGNRLSPEQKSAIENYRKAYGI

SEQ ID NO: 852 - skipped

SEQ ID NO: 853 - DNA, 3027 bp, Artificial Sequence
  SS2d-G11 Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgaccgaattagattatcaaggaactgctgaggcggcttctacctcgtatagtcgaaatcaaacggaccttaagccgtttccttctgcaggcagtgcatcttcatcaattaaaacgacggaacctgtgaaagatcatagaagaaggcgttcttccagcataatttcacatgtggaaccggagacttttgaagatgaaaatgaccagcaacttctaccaaatatgaatgctacttgggtagaccaacgcggcgcttggattattcatgtggtcattatcatactgctgaaactattttataatttatttcctggtgttaccacagaatggtcgtggactctgactaatatgacatatgttattgggtcctatgtcatgttccatctgattaagggtacccctttcgatttcaatggtggtgcttatgacaacttgacgatgtgggaacaaattgacgacgagactttatatactccttcaagaaaatttttgattagtgtcccgatcgccctattcttagttagtactcattatgctcactatgatttgaaattgttttcatggaattgttttttgacaacctttggtgctgttgtcccaaagttacctgttactcatagattaaggatttctatcccaggtatcacaggtcgcgcccaaattagttga

SEQ ID NO: 854 - protein, 1008 aa, Artificial Sequence
  SS2d-G11 Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMTELDYQGTAEAASTSYSRNQTDLKPFPSAGSASSSIKTTEPVKDHRRRRSSSIISHVEPETFEDENDQQLLPNMNATWVDQRGAWIIHVVIIILLKLFYNLFPGVTTEWSWTLTNMTYVIGSYVMFHLIKGTPFDFNGGAYDNLTMWEQIDDETLYTPSRKFLISVPIALFLVSTHYAHYDLKLFSWNCFLTTFGAVVPKLPVTHRLRISIPGITGRAQIS

SEQ ID NO: 855 - DNA, 2955 bp, Artificial Sequence
  SS2e-A7a Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgccaagagtagctatcatcatttacacactatatggtcacgttgctgccaccgcagaggcagaaaagaagggaattgaagccgctggaggctctgcagacatttatcaagtcgaggaaacgttgtctccagaagttgttaaggcgcttggcggtgctccaaagccagattacccaattgccactcaagatacgttgacagaatatgatgcctttttgtttggtattccaactagatttggtaacttccctgctcaatggaaggctttctgggaccgtaccggtgggttgtgggctaagggtgctttgcatggtaaggtcgctggttgtttcgtctccaccggaactggtggtggtaatgaagccacaattatgaactctttgtctactttggctcatcacggtatcatttttgtcccattgggttacaagaatgttttcgctgaattgaccaatatggatgaagttcacggtggttcaccatggggtgcgggtaccattgcaggcagtgacggttcaagatctccttccgccttggaattacaagtacacgaaattcaaggcaagactttctacgaaaccgttgcaaagttttga

SEQ ID NO: 856 - protein, 984 aa, Artificial Sequence
  SS2e-A7a Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMPRVAIIIYTLYGHVAATAEAEKKGIEAAGGSADIYQVEETLSPEVVKALGGAPKPDYPIATQDTLTEYDAFLFGIPTRFGNFPAQWKAFWDRTGGLWAKGALHGKVAGCFVSTGTGGGNEATIMNSLSTLAHHGIIFVPLGYKNVFAELTNMDEVHGGSPWGAGTIAGSDGSRSPSALELQVHEIQGKTFYETVAKF

SEQ ID NO: 857 - skipped

SEQ ID NO: 858 - DNA, 3699 bp, Artificial Sequence
  SS4d-G5 Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgggaaagaacgttttgttgctaggatctggttttgttgcacaacctgttatcgacacattggctgctaatgatgacatcaatgtcactgtcgcatgtagaacattagccaatgcgcaagcattggccaagccctctggatccaaggctatttcattggatgttaccgatgacagtgccttagacaaagttctggctgataacgatgttgtcatctctttgattccatacaccttccatccaaatgtggtaaagagcgccatcagaacaaagaccgatgtcgtcacttcctcttacatctcacctgccttaagagaattggaaccagaaatcgtaaaggcaggtattacagttatgaacgaaattgggttggatccaggtatcgaccacttgtatgcggtcaagactattgatgaagttcacagagctggtggtaagctaaagtcattcttgtcatactgtggtggtttaccagctcctgaagactctgataatccattaggatacaaattttcatggtcctccagaggtgtgctactggctttaagaaactctgctaaatactggaaagacggaaagattgaaactgtttcttccgaagacttaatggccactgctaagccttacttcatctacccaggttatgcattcgtttgctacccaaatagagactctacccttttcaaggatctttatcatattccagaagccgaaacggtcattagaggtactttgagatatcaaggtttcccagaatttgttaaggctttagttgacatgggtatgttgaaggatgatgctaacgaaatcttcagcaagccaattgcctggaacgaagcactaaaacaatatttaggtgccaagtctacttctaaagaagatttgattgcttccattgactcaaaggctacttggaaagatgatgaagatagagaaagaatcctttccgggtttgcttggttaggcttgttctctgacgcaaagatcacaccaagaggtaatgctttagacactctatgtgcacgtttagaagaactaatgcaatatgaagacaatgaaagagatatggttgtactacaacacaaattcggtattgaatgggctgatggaactaccgaaacaagaacatccactttagttgactatggtaaggttggtggttacagttctatggccgctactgttggttatccagttgccattgcaacgaaattcgtcttagatggtacaatcaagggaccaggcttactagcgccatactcaccagagattaatgatccaatcatgaaagaactaaaggacaagtacggcatctatctaaaggaaaagacagtggcttaa

SEQ ID NO: 859 - protein, 1232 aa, Artificial Sequence
  SS4d-G5 Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMGKNVLLLGSGFVAQPVIDTLAANDDINVTVACRTLANAQALAKPSGSKAISLDVTDDSALDKVLADNDVVISLIPYTFHPNVVKSAIRTKTDVVTSSYISPALRELEPEIVKAGITVMNEIGLDPGIDHLYAVKTIDEVHRAGGKLKSFLSYCGGLPAPEDSDNPLGYKFSWSSRGVLLALRNSAKYWKDGKIETVSSEDLMATAKPYFIYPGYAFVCYPNRDSTLFKDLYHIPEAETVIRGTLRYQGFPEFVKALVDMGMLKDDANEIFSKPIAWNEALKQYLGAKSTSKEDLIASIDSKATWKDDEDRERILSGFAWLGLFSDAKITPRGNALDTLCARLEELMQYEDNERDMVVLQHKFGIEWADGTTETRTSTLVDYGKVGGYSSMAATVGYPVAIATKFVLDGTIKGPGLLAPYSPEINDPIMKELKDKYGIYLKEKTVA

SEQ ID NO: 860 - skipped

SEQ ID NO: 861 - DNA, 3336 bp, Artificial Sequence
  SS4d-C7 Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgtcacgtcttcctctaaagcagttcttagcggataaccccaaaaaagttcttgttcttgacggtggtcaaggaacagaactggaaaacagaggtatcaaagttgcaaatcccgtgtggtctactattccatttattagcgaatcattttggtctgatgagtcatctgctaacagaaaaattgtcaaagaaatgttcaacgatttcttgaatgctggcgcagaaatattgatgactacaacataccaaacgagttataaatcagtttctgaaaacaccccaatcagaactttatccgagtacaataaccttttaaacaggattgtcgatttttctcgtaattgtattggcgaagacaaatatttgattggctgtattggcccatggggtgctcatatttgtcgtgagtttacaggcgactatggtgctgagccagaaaatattgatttctaccaatacttcaagcctcagttggagaatttcaataaaaatgacaaattggatttgattgggtttgaaaccattcctaacatccatgaactgaaagctatcttatcttgggatgagagtatcctgtctagacccttctatatcgggttgtctgtgcatgagcacggtgtcttgagagacggcactaccatggaagaaatcgcacaagttattaaggacttgggcgacaaaataaatcctaacttctcgttcttaggaatcaactgcgtcagcttcaaccaatcacccgacattcttgagtctctacatcaagcactaccaaatatggccttgcttgcttatccaaacagtggtgaagtttatgatactgaaaagaagatatggttgccaaatagcgataagctgaacagttgggatacggttgttaaacagtacattagcagcggtgcccgtatcattggtggttgttgcagaacaagtccaaaagacatccaagagatttctgcagccgtcaagaaatacacgtaa

SEQ ID NO: 862 - protein, 1111 aa, Artificial Sequence
  SS4d-C7 Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMSRLPLKQFLADNPKKVLVLDGGQGTELENRGIKVANPVWSTIPFISESFWSDESSANRKIVKEMFNDFLNAGAEILMTTTYQTSYKSVSENTPIRTLSEYNNLLNRIVDFSRNCIGEDKYLIGCIGPWGAHICREFTGDYGAEPENIDFYQYFKPQLENFNKNDKLDLIGFETIPNIHELKAILSWDESILSRPFYIGLSVHEHGVLRDGTTMEEIAQVIKDLGDKINPNFSFLGINCVSFNQSPDILESLHQALPNMALLAYPNSGEVYDTEKKIWLPNSDKLNSWDTVVKQYISSGARIIGGCCRTSPKDIQEISAAVKKYT

SEQ ID NO: 863 - DNA, 2391 bp, Artificial Sequence
  SS3b-D8 Full gene NT Seq
atgtcgcaagagttcgagacaccggcggttggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 864 - protein, 796 aa, Artificial Sequence
  SS3b-D8 Full Gene AA seq
MSQEFETPAVGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 865 - protein, 10 aa, Artificial Sequence
  SS3b-D8 Fusion AA seq
MSQEFETPAV

SEQ ID NO: 866 - DNA, 2394 bp, Artificial Sequence
  SS2c-A10a Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgaattcgaatgaagacatcatacctgaactataa

SEQ ID NO: 867 - skipped

SEQ ID NO: 868 - DNA, 2394 bp, Artificial Sequence; identical to SEQ ID NO: 866
  SS2c-A10a Full gene NT Seq

SEQ ID NO: 869 - protein, 797 aa, Artificial Sequence
  SS2c-A10a Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMNSNEDIIPEL

SEQ ID NO: 870 - protein, 11 aa, Artificial Sequence
  SS2c-A10a Fusion AA seq
MNSNEDIIPEL

SEQ ID NO: 871 - DNA, 1422 bp, Artificial Sequence
  Pathway step 3 sequence A  CYP87D18 DNA (codon optimized)
atgtggacagttgtgttgggacttgctaccttgtttgttgcctattatattcattggatcaacaagtggagagattccaagttcaatggtgttctacctcctggaactatggggctaccattgataggagagacaattcagttgtcaagaccatctgacagtttggatgtgcatccctttatccagaagaaagtcgaacgttatggtccgatatttaaaacctgtttggcaggcagaccagttgttgtttcagcggatgcagagttcaataattacattatgttacaagaaggtagagctgtagaaatgtggtatttggacacactgtctaaattcttcgggttggatacagagtggttaaaagccttaggcttaatccacaagtacataagatccattaccctaaaccattttggtgctgaagcattgagagaaagattcttgccatttatagaggcatcgtctatggaagcgttacattcttggtccactcaacccagtgtggaggtcaagaatgcaagtgctttgatggtattcagaacgtctgtaaacaaaatgtttggagaagatgctaagaaattatcaggaaatattccaggtaaattcacaaagctgctgggtggctttctatctctaccgttaaattttcccggcactacttatcacaagtgcttaaaagacatgaaagaaatccagaagaaattacgtgaagttgtagatgatagacttgccaatgttgggccagatgttgaggactttctagggcaagcgttgaaagacaaagaatccgagaaattcataagcgaagaatttatcatccaattgctattttcaataagctttgcttcgttcgaatcgatcagcacgacgttgacattgattttgaagctacttgacgaacatcctgaggttgtaaaggaattagaagccgaacatgaagctatcagaaaagctagagctgatccagatggtccaattacctgggaagaatacaaatctatgaccttcacacttcaagtcataaacgaaacacttaggttaggctcagtgactcctgccttattgaggaaaactgttaaagatctgcaagtcaagggttacattattcctgaaggatggactataatgttggtaactgcatctaggcatcgtgatccaaaggtctacaaagatccgcacatattcaatccttggagatggaaagacctggactcaattaccattcaaaagaactttatgccattcggtggtggtttaaggcattgtgcaggagctgaatactccaaagtgtatctgtgtacttttcttcacattctttgcacaaaatataggtggacgaagttaggtggcggtagaattgcaagagcccatattttaagttttgaggatggtttgcacgtcaagtttactcctaaagagtaa

SEQ ID NO: 872 - protein, 473 aa, Artificial Sequence; identical to SEQ ID NO: 49
  Pathway step 3 sequence B CYP87D18 Protein

SEQ ID NO: 873 - DNA, 2106 bp, Artificial Sequence
  Pathway step 3 sequence C SgCPR DNA (codon optimized)
atgaaggtcagtccattcgaattcatgtccgctattatcaagggtagaatggacccatctaactcctcatttgaatctactggtgaagttgcctccgttatctttgaaaacagagaattggttgccatcttgaccacttctattgctgttatgattggttgcttcgttgtcttgatgtggagaagagctggttctagaaaggttaagaatgtcgaattgccaaagccattgattgtccatgaaccagaacctgaagttgaagatggtaagaagaaggtttccatcttcttcggtactcaaactggtactgctgaaggttttgctaaggctttggctgatgaagctaaagctagatacgaaaaggctaccttcagagttgttgatttggatgattatgctgccgatgatgaccaatacgaagaaaaattgaagaacgaatccttcgccgttttcttgttggctacttatggtgatggtgaacctactgataatgctgctagattttacaagtggttcgccgaaggtaaagaaagaggtgaatggttgcaaaacttgcactatgctgtttttggtttgggtaacagacaatacgaacacttcaacaagattgctaaggttgccgacgaattattggaagctcaaggtggtaatagattggttaaggttggtttaggtgatgacgatcaatgcatcgaagatgatttttctgcttggagagaatctttgtggccagaattggatatgttgttgagagatgaagatgatgctactactgttactactccatatactgctgctgtcttggaatacagagttgtctttcatgattctgctgatgttgctgctgaagataagtcttggattaacgctaatggtcatgctgttcatgatgctcaacatccattcagatctaacgttgtcgtcagaaaagaattgcatacttctgcctctgatagatcctgttctcatttggaattcaacatttccggttccgctttgaattacgaaactggtgatcatgttggtgtctactgtgaaaacttgactgaaactgttgatgaagccttgaacttgttgggtttgtctccagaaacttacttctctatctacaccgataacgaagatggtactccattgggtggttcttcattgccaccaccatttccatcatgtactttgagaactgctttgaccagatacgctgatttgttgaactctccaaaaaagtctgctttgttggctttagctgctcatgcttctaatccagttgaagctgatagattgagatacttggcttctccagctggtaaagatgaatatgcccaatctgttatcggttcccaaaagtctttgttggaagttatggctgaattcccatctgctaaaccaccattaggtgttttttttgctgctgttgctccaagattgcaacctagattctactccatttcatcctctccaagaatggctccatctagaatccatgttacttgtgctttggtttacgataagatgccaactggtagaattcataagggtgtttgttctacctggatgaagaattctgttccaatggaaaagtcccatgaatgttcttgggctccaattttcgttagacaatccaattttaagttgccagccgaatccaaggttccaattatcatggttggtccaggtactggtttggctccttttagaggttttttacaagaaagattggccttgaaagaatccggtgttgaattgggtccatccattttgtttttcggttgcagaaacagaagaatggattacatctacgaagatgaattgaacaacttcgttgaaaccggtgctttgtccgaattggttattgctttttctagagaaggtcctaccaaagaatacgtccaacataagatggctgaaaaggcttctgatatctggaacttgatttctgaaggtgcttacttgtacgtttgtggtgatgctaaaggtatggctaaggatgttcatagaaccttgcataccatcatgcaagaacaaggttctttggattcttccaaagctgaatccatggtcaagaacttgcaaatgaatggtagatacttaagagatgtttggtaa

SEQ ID NO: 874 - protein, 701 aa, Artificial Sequence; identical to SEQ ID NO: 113
  Pathway step 3 sequence D SgCPR Protein

SEQ ID NO: 875 - DNA, 1461 bp, Artificial Sequence
  Pathway step 3 sequence E CYP51G1 (codon optimized)
atggaacctgaaaacaagttcttcaatgttgggttattgatcgtagttacgttggttttggctaaactaatttctgcggtcattaattccaggtctaagaagagagtacctccaaccgtcaaaggttttccacttgtaggtggcttggttagatttcttaaagggccaattgtgatgttgagagaagaatatcccaaacatggatccgtattcactctgaatttactacataagaagattacctttctgattggaccagaagtttctgcacatttctttaaggcttcagagagtgatttatcacagcaagaagtctaccaatttaacgtgcccacttttggtccgggcgttgttttcgatgtcgactactcggtaaggcaagaacaattcagattctttaccgaagcattgagagttacaaaactgaagggctatgttgaccaaatggtgaaagaagcagaagattacttttcaaaatggggtgattcaggagaggttgatctaaaatgcgaacttgaacacttgatcatattaaccgcatctagatgtttgttgggaagagaagttcgtgaccagttatttgctgatgtaagtgccctatttcatgacttggataacggtatgctgccaatatccgtgatgttcccatacttgcctatacccgctcataggagaagagatcaagcgagatcaaaattggctgatatctttgtcaacatcatatcctctcgtaaatgtactggcacttctgaaaatgacatgttacaatgctttataaactctaaatacaaagatggcagaccaactactgattctgaaatcacagggttattgatagccgcattattcgctgggcaacatacgagctcgattactagcacatggacaggcgcatatttgttatgtcacaaagagtatatgagtgccgttcttgaagagcagcagaaacaaatggagaagcatggtgacgaaattgatcacgatattctatccgaaatggacaatttgtaccgttgcatcaaagaagccctaagactacatccacccttgattatgcttatgaggtcgagtcataccgattttagcgttacgacaagagaaggaaaagagtatgatattccgaagggacatattatagccacaagtccagctttcgcaaatcgtttacctcacgtgtataaagaccctgacagatttgatccagataggtttgctccaggtagagatgaggataaggctgctggacctttctcctacatatcatttggtggtggtagacacggttgtttaggtgaaccttttgcgtatttacaaatcaaggcaatctggtcacacttactgagaaattttgagttagagttgattagtcctttcccggaaattgactggaatgccatggttgtgggtgtcaagggtaaagtgatggtcaggtataagagaagaaagcttagcgtatcttag

SEQ ID NO: 876 - protein, 486 aa, Artificial Sequence
  Pathway step 3 sequence F CYP51G1 Protein
MEPENKFFNVGLLIVVTLVLAKLISAVINSRSKKRVPPTVKGFPLVGGLVRFLKGPIVMLREEYPKHGSVFTLNLLHKKITFLIGPEVSAHFFKASESDLSQQEVYQFNVPTFGPGVVFDVDYSVRQEQFRFFTEALRVTKLKGYVDQMVKEAEDYFSKWGDSGEVDLKCELEHLIILTASRCLLGREVRDQLFADVSALFHDLDNGMLPISVMFPYLPIPAHRRRDQARSKLADIFVNIISSRKCTGTSENDMLQCFINSKYKDGRPTTDSEITGLLIAALFAGQHTSSITSTWTGAYLLCHKEYMSAVLEEQQKQMEKHGDEIDHDILSEMDNLYRCIKEALRLHPPLIMLMRSSHTDFSVTTREGKEYDIPKGHIIATSPAFANRLPHVYKDPDRFDPDRFAPGRDEDKAAGPFSYISFGGGRHGCLGEPFAYLQIKAIWSHLLRNFELELISPFPEIDWNAMVVGVKGKVMVRYKRRKLSVS

SEQ ID NO: 877 - DNA, 1515 bp, Artificial Sequence
  Pathway step 3 sequence G CYP71B97 (codon optimized)
atgttatcgttggccatttgggtttcacttttgttcttgttgtcatcattgcttcttttaaagacgaagaagaaagttgctccacaaaagaagaagaagcaatttccacctggacctcccaaactaccattgttaggccatctgcacttattgggttctttgcctcattgctccttatgtgaactgtctagaaaatatggtcctgtcatgttgttaaaattaggctcagtacctaccgtagtcatatctagcgctgcagccgctagagaggtgttgaaagtacacgatctagcatgttgctctcgtccgagattggctgcttccggtagattctcgtacaattttctggatctgaacttaagcccatatggtgagagatggagagaactgaggaaaatttgcgtattggttttgctgagtgctagacgtgttcagagcttccaacagataagagaagaagaggtgggattattacttaaatccattagtcaagtttccagtagtgccactccagttgatctatctgagaaatcctattctttgacagctaacattatcactagaatcgcgtttgggaagtcattcagaggtggcgaattagacaatgaaaactttcaacaagtcatccacagagcatcgattgccttaggttccttttctgtgacaaacttctttccttcagtagggtggattatcgacagattaaccggtgtacatggcagattggagaagagttttgctgaattagacaccttctttcagcatatcattgatgatcgtatcaattttgtcgcaacaagccaaaccgaagaaaacattatagacgtactattgaaaatggaaagagaacgttcaaaatttgatgtcctacaactgaatagggactgcataaaagccttgataatggatatatttcttgccggtgtagatactggagcagggacaattgtgtgggcattgactgaattggtgagaaatcccagagtgatgaagaagttgcaagacgaaataaggtcgtgtgtgaaagaggatcaagtcaaggaacgtgatttagagaaacttcagtacttaaagatggtcgttaaagaagttttaagattgcatgctccagttcctttgttattgccgagagagacaatgtctcatttcaaactaaatggttatgacattgatccgaaaactcacttgcatgtcaatgtttgggcgattggtagggacccagattcttggtctgatccagaagaattcttcccagaaagattcgcaggatcaagtattgattacaaaggacataattttgaattgctgccatttggtggtggcagaaggatctgtcccggtatgaacatggggacagttgcggttgaacttgcactaacgaacctattactttgttttgattggactctacctgatggcatgaaagaggaagatgttgacatggaagaagatggtggacttgctattgctaagaaatctcccctaaaattagttccagttaggtgtcttaattag

SEQ ID NO: 878 - protein, 504 aa, Artificial Sequence
  Pathway step 3 sequence H CYP71B97 Protein
MLSLAIWVSLLFLLSSLLLLKTKKKVAPQKKKKQFPPGPPKLPLLGHLHLLGSLPHCSLCELSRKYGPVMLLKLGSVPTVVISSAAAAREVLKVHDLACCSRPRLAASGRFSYNFLDLNLSPYGERWRELRKICVLVLLSARRVQSFQQIREEEVGLLLKSISQVSSSATPVDLSEKSYSLTANIITRIAFGKSFRGGELDNENFQQVIHRASIALGSFSVTNFFPSVGWIIDRLTGVHGRLEKSFAELDTFFQHIIDDRINFVATSQTEENIIDVLLKMERERSKFDVLQLNRDCIKALIMDIFLAGVDTGAGTIVWALTELVRNPRVMKKLQDEIRSCVKEDQVKERDLEKLQYLKMVVKEVLRLHAPVPLLLPRETMSHFKLNGYDIDPKTHLHVNVWAIGRDPDSWSDPEEFFPERFAGSSIDYKGHNFELLPFGGGRRICPGMNMGTVAVELALTNLLLCFDWTLPDGMKEEDVDMEEDGGLAIAKKSPLKLVPVRCLN

SEQ ID NO: 879 - DNA, 1518 bp, Artificial Sequence
  Pathway step 3 sequence I CYP73A152 (codon optimized)
atggatttgcttttgttggaaaagacgttgttgggtctatttatcgctgtcgtattggcaatagccattagcaaattaaggggtaaaaggtttaaactgccaccaggtccgttacctgtccctatctttggcaactggttacaggttggtgatgatttgaaccacagaaatctaacgggtttagccaagaaatttggggatattttcttgttaagaatgggccaaagaaacttagtggtagtttcatctcctgaacttgccaaagaagtgcttcatacacaaggagtggagtttggatctagaacaagaaatgtagtgttcgacatatttaccggaaaaggtcaagatatggttttcacagtatatggtgaacattggcgtaaaatgcgtagaataatgactgtaccattcttcaccaacaaggttgtccaacaatataggcatggatgggaagcagaagcagctagcgttgttgaagatgtgaagaagaatccggaatctgctactactggtattgtgttacgtcgtagacttcaattgatgatgtacaataacatgtatcgtataatgtttgacagaagatttgagtccgaggatgatcccctatttcacaaattgagagcactgaatggtgagagatctaggttggctcaatcgttcgagtacaactatggagacttcatccctattttaagacctttcttgagaggctatttgaaaatttgcaaggaagtcaaggacactaggttacagttgtttaaagactactttgttgaagaaagaaagaaattggcgaacgtgaaaactaccacaaatgagggcttaaaatgtgcgatcgatcacattctggacgcacaacagaaaggtgaaatcaatgaagataacgttttatacattgttgagaatattaatgtagctgccattgaaactacgttgtggtcgatagaatggggaattgcagagcttgtcaatcatcctgaaatccaaagaaagctgagaaatgagatggatacagtcttaggctcaggtgttcctatcactgaaccagatacacataagttgccctatttacaagctgtcataaaagaaactcttagacttagaatggctatacccttgctagttccacatatgaatctacatgatgccaaactgggtggttacgacattccagcagaatccaagattctagtaaacgcttggtggttagccaataatccagctaattggaagaatccagaagaattcagaccagagagattcttggaagaagaatccaaagttgaagctaatgggaacgactttagatatttaccgttcggtgtaggaagaaggagttgtccagggataattttagcgctacctatcctagctatcaccataggcagactggttcagaactttgaattgttacctccaccagggcaaagtaagctggatacaagtgagaagggtggtcagttttcattgcatattcttaaacactcaaccattgtcgttaaacccagggcattttag

SEQ ID NO: 880 - protein, 505 aa, Artificial Sequence
  Pathway step 3 sequence J CYP73A152 Protein
MDLLLLEKTLLGLFIAVVLAIAISKLRGKRFKLPPGPLPVPIFGNWLQVGDDLNHRNLTGLAKKFGDIFLLRMGQRNLVVVSSPELAKEVLHTQGVEFGSRTRNVVFDIFTGKGQDMVFTVYGEHWRKMRRIMTVPFFTNKVVQQYRHGWEAEAASVVEDVKKNPESATTGIVLRRRLQLMMYNNMYRIMFDRRFESEDDPLFHKLRALNGERSRLAQSFEYNYGDFIPILRPFLRGYLKICKEVKDTRLQLFKDYFVEERKKLANVKTTTNEGLKCAIDHILDAQQKGEINEDNVLYIVENINVAAIETTLWSIEWGIAELVNHPEIQRKLRNEMDTVLGSGVPITEPDTHKLPYLQAVIKETLRLRMAIPLLVPHMNLHDAKLGGYDIPAESKILVNAWWLANNPANWKNPEEFRPERFLEEESKVEANGNDFRYLPFGVGRRSCPGIILALPILAITIGRLVQNFELLPPPGQSKLDTSEKGGQFSLHILKHSTIVVKPRAF

SEQ ID NO: 881 - DNA, 1494 bp, Artificial Sequence
  Pathway step 3 sequence K CYP80C13 (codon optimized)
atgttaaaagatcccttttgctttccctttctacctctgttgagtttggctgttcttctgttcttactattgagaaggatctgctctaaatctaagcctagacctttgcctccgggtcctactccatggcctgtggtcggaaatctattgcaaataggcacaaatccccatatttcgatcactcaattttctcaaacttacggtccgttgatttccttgcgtttgggaactagcttattggtcgttgcatcgtcaccagctgctgctactgccgttcttagaacacatgatagattacttagtgcgagatatatgttccagacgattcctgacaaacgtaaacatgcccaattgtccttatctacatcgccattctgcgatgaccattggaagtcattgagaagcatttgtagagcaaacttattcacgtccaaggctatagagtcacaaggaggtcttagaagaagaaagatgaaagagatggtggaatttctacaatccaaacaaggtacggttgtaggtgttagggacttagtgtttaccaccgttttcaacatcttatccaacttggtgttctcaagagacttagttggctatgtaggtgaaggtttcaatgggattaagtcatcttttcaccgttctatgaaattagggttaacacctaatctggcagacttttatccaatactggaagggttcgatcttcaaggactacagaagaaggctgtactatataacaaaggagttgattctacatgggaaatcctagtcaaagaaaggagagaattacacaggaacaacttggtagtttcaccgaatgacttcttggatgttttgatacagaatcaattcagtgatgatcagatcaactacttgattaccgaggttctaacagctggtattgatacaaccacttctaccgttgaatgggctatggcggaactgttaaagaataaggatttaactgagaaagtcagggtcgaattggaaagagagatgaaaatcaaggaaaatgcgattgatgagagtcagattagtcaatttcagtttcttcaacagtgtgtcaaagaaactttgagactttatccaccagtgccatttctgttaccaagactagcaccagaaccttgtgaagtgatgggttacagtattccgaaagatacctcgatatttgttaacgcatggggcattggtagagatccatctatatgggaggaaccctcagcattcaaaccagaaagatttgtcaattcagacttagactttaaagcctatgattacagattcttgccttttggtggaggcagaagatcttgtccaggccttttgatgacaactgtacaagtaccattgataattgccacgttaatccacaattttgactggagcctacctaatggcggtgatttggcccaattggatttaagcggtcaaatgggtgtatccttacaaaaggaaaagccactgttgcttattcccaggaaacgtacttag

SEQ ID NO: 882 - protein, 497 aa, Artificial Sequence
  Pathway step 3 sequence L CYP80C13 Protein
MLKDPFCFPFLPLLSLAVLLFLLLRRICSKSKPRPLPPGPTPWPVVGNLLQIGTNPHISITQFSQTYGPLISLRLGTSLLVVASSPAAATAVLRTHDRLLSARYMFQTIPDKRKHAQLSLSTSPFCDDHWKSLRSICRANLFTSKAIESQGGLRRRKMKEMVEFLQSKQGTVVGVRDLVFTTVFNILSNLVFSRDLVGYVGEGFNGIKSSFHRSMKLGLTPNLADFYPILEGFDLQGLQKKAVLYNKGVDSTWEILVKERRELHRNNLVVSPNDFLDVLIQNQFSDDQINYLITEVLTAGIDTTTSTVEWAMAELLKNKDLTEKVRVELEREMKIKENAIDESQISQFQFLQQCVKETLRLYPPVPFLLPRLAPEPCEVMGYSIPKDTSIFVNAWGIGRDPSIWEEPSAFKPERFVNSDLDFKAYDYRFLPFGGGRRSCPGLLMTTVQVPLIIATLIHNFDWSLPNGGDLAQLDLSGQMGVSLQKEKPLLLIPRKRT

SEQ ID NO: 883 - DNA, 1530 bp, Artificial Sequence
  Pathway step 3 sequence M CYP92A127 (codon optimized)
atggaagctccctcgtgggtgtcttatgccgcagcttgggttgcaacattggctctattgttacttagtaggcgtttgagaagaagaaaattgaatttgccacctggacctaaaccctggccattaattggcaatttaaacctaataggttctttaccgcatcaatccatccatcaattgtcccaaaagtatggcccaataatgcacttgagatttggatcatttcctgttgtagttggcagttctgtggatatggccaagatcttcttgaaaactcaggatctaaccttcgtttcacgtccaaagacagcagctggcaaatacaccacttacaattatagcaatataacgtggtcacaatatggtccttattggagacaagcgaggaaaatgtgtttgatggaattgttctctgctagaagattggacagttatgaatacattaggaaagaagagatgaatgccttgcttaaggaaatttgcaaaagttcgggaaaagtcatcaaactaaaggactacctatctacagtttccttgaacgtgataagcaggatggtcttagggaagaaatacactgacgagtcagaagatgcaatcgttagtccagacgaatttaagaaaatgcttgacgaattgtttcttctatctggtgtattgaacatcggtgattcgataccgtggattgatttcttagatctacagggttacgtgaaacgtatgaaagctttgtccaagaaattcgacagatttctggagcatgttttagacgagcataatgagagaagaaaaggtgtcaaagattatgtagctaaagacatggtcgatgtactgttacaactggcagatgatccggatcttgaggtgaaattggaacgtcacggtgttaaggcgttcacacaagacttaatagccggtggtacagaatcttccgctgtcactgtagaatgggcaatgagcgaacttctaaagaaaccagagatgttcgaaaaggcctctgaagagttagatagagtgattggtagggaaagatgggttgaggaaaaggatatcgcgaatttaccctatattgacgcaattgctaaagaaaccatgaggttacatcctgtggcaccaatgttggtacctagattatgcagagaagattgtcagattgctggctacgatatagcaaagggcactagagttcttgtcaacgtttggacaattggaagagatccaactgtttgggaaaatccggatgaatttaacccagaaagatttcttgggaaatcaattgatgtcaaagggcaagactttgagttgttaccctttggaagtggtagaagaatgtgtcctggatattcactgggtttaaaagttattcagtcatcactagccaacttattgcatgggttttcctggaagctggctggtgataccaagaaagaagatttgaatatggaagaagtattcggtttaagcacgccaaagaagtttcctttggatgctgttgccgaaccaagactgcctccacacctgtattctatgtag

SEQ ID NO: 884 - protein, 509 aa, Artificial Sequence
  Pathway step 3 sequence N CYP92A127 Protein
MEAPSWVSYAAAWVATLALLLLSRRLRRRKLNLPPGPKPWPLIGNLNLIGSLPHQSIHQLSQKYGPIMHLRFGSFPVVVGSSVDMAKIFLKTQDLTFVSRPKTAAGKYTTYNYSNITWSQYGPYWRQARKMCLMELFSARRLDSYEYIRKEEMNALLKEICKSSGKVIKLKDYLSTVSLNVISRMVLGKKYTDESEDAIVSPDEFKKMLDELFLLSGVLNIGDSIPWIDFLDLQGYVKRMKALSKKFDRFLEHVLDEHNERRKGVKDYVAKDMVDVLLQLADDPDLEVKLERHGVKAFTQDLIAGGTESSAVTVEWAMSELLKKPEMFEKASEELDRVIGRERWVEEKDIANLPYIDAIAKETMRLHPVAPMLVPRLCREDCQIAGYDIAKGTRVLVNVWTIGRDPTVWENPDEFNPERFLGKSIDVKGQDFELLPFGSGRRMCPGYSLGLKVIQSSLANLLHGFSWKLAGDTKKEDLNMEEVFGLSTPKKFPLDAVAEPRLPPHLYSM

SEQ ID NO: 885 - DNA, 1530 bp, Artificial Sequence
  Pathway step 3 sequence O CYP92A129 (codon optimized)
atggaggcaccaccgtgggtttcatatgcagctgcgtgggtagcaacattggctctgttacttctgtctagacatttgcgtagaagaaaattgaatttaccacctggtccaaagccttggcctctaattggcaatctgaacttgataggatcgctaccacatcaatccatacatcaattgagtcagaaatatggcccaattatgcagttaagatttggttcttttcccgttgttgttggttcaagcgtagatatggccaaaattttcctgaaaacacacgatcttacgtttgtgagcagaccgaaaactgctgcaggcaaatacaccacgtataactgttccaatataacttggtcgcaatatggtccgtattggagacaagccaggaaaatgtgtttgatggagctgtttagcgctagacgtctggattcatacgaatacatcagaaaagaggaaatgaatgcactattgaaggagatttgcaaaagtagtgggaaagtaatcaaacttaaagactatttgtctactgtctcgcttaatgtcatcagtagaatggtgctaggaaagaagtacaccgatgagtctgaagatgccattgtttctcccgatgaatttaagaaaatgttggatgaattgtttctactgggcggtgttttgaacatcggtgattccataccttggatcgacttcttagatcttcaaggatatgtcaagagaatgaaggctttatcaaagaaatttgatcgttttctagaacacgtactagatgaacacaacgagcgtagaaaaggtgtgaaggattatgttgctaaggacatggtcgatgtgttattgcaattggctgacgatccagacttggaagtcaggttagagaggcatggtgttaaggcgtttacccaagacttgattgcaggaggaacagaatcatccgcagtaacagtagaatgggccatgtctgaattgttaaagaagcccgaaatgttcgagaaagcctcagaagagctagacagagtgattggtagggaaagatgggttgaagagaaagacatagccaatttaccgtatatagacgccatcgctaaagaaaccatgagattgcatccagtcgcacctatgctagttccacgtttatgcagagaagattgtcagattgctggatacgatattgctaagggtactagagtcttggtgaacgtttggacaattggtagggatcctactgtatgggaaaatcctgatgaattcaatcccgaaagattcttagggaaatccatcgatgtcaaaggtcaagacttcgaattattgccattcggatcaggcagaagaatgtgtccagggtactccttaggcttaaaggttatacagagtagcttagcaaatcttttgcatggtttctcttggagacttgctggggacgttaagaaagaagatttaaacatggaagaagtgtttggtctttctactcccaagaaatttccattggatgcggttgctgaacctaggttaccacctcacttgtactctatttag

SEQ ID NO: 886 - protein, 509 aa, Artificial Sequence
  Pathway step 3 sequence P) CYP92A129 Protein
MEAPPWVSYAAAWVATLALLLLSRHLRRRKLNLPPGPKPWPLIGNLNLIGSLPHQSIHQLSQKYGPIMQLRFGSFPVVVGSSVDMAKIFLKTHDLTFVSRPKTAAGKYTTYNCSNITWSQYGPYWRQARKMCLMELFSARRLDSYEYIRKEEMNALLKEICKSSGKVIKLKDYLSTVSLNVISRMVLGKKYTDESEDAIVSPDEFKKMLDELFLLGGVLNIGDSIPWIDFLDLQGYVKRMKALSKKFDRFLEHVLDEHNERRKGVKDYVAKDMVDVLLQLADDPDLEVRLERHGVKAFTQDLIAGGTESSAVTVEWAMSELLKKPEMFEKASEELDRVIGRERWVEEKDIANLPYIDAIAKETMRLHPVAPMLVPRLCREDCQIAGYDIAKGTRVLVNVWTIGRDPTVWENPDEFNPERFLGKSIDVKGQDFELLPFGSGRRMCPGYSLGLKVIQSSLANLLHGFSWRLAGDVKKEDLNMEEVFGLSTPKKFPLDAVAEPRLPPHLYSI

SEQ ID NO: 887 - DNA, 1155 bp, Artificial Sequence
  Pathway step 3 sequence Q CYP92A458 (codon optimized)
atggaaatgtcatcatgtgtagccgctacgattagcatctggatggtggttgtttgtattgtgggtgttggatggagagtggtaaattgggtttggctaagacccaagaaattggagaaaaggttaagggaacaaggcttggcagggaactcttacagattgttatttggtgaccttaaagaacgtgcagcaatggctgaacaagccaattcaaaaccgattaattttagtcacgacattggtccaagagttttcccaagtatgtacaaaaccattcagaattatgggaagaattcctacatgtggttaggtccctatccaagagtgcatataatggatcctcaacagctgaaaaccgtctttacattggtttatgacattcaaaagccgaatctgaatccactggtcaaattcttgttagatgggattgtcactcatgaaggagaaaagtgggcaaagcatagaaagatcattaatccagcttttcaccttgaaaagttgaaggacatgattcctgccttctttcactcttgcaatgagatagttaatgagtgggaaagactaatttcgaaggagggttcctgtgaacttgatgttatgccttacttgcagaacttagctgctgatgctatatccagaacagcgtttggttctagctatgaagagggtaaaatgatattccaattacttaaggaattgactgatttggtcgtaaaagtagcgtttggtgtgtatatccctggttggagattcttaccaaccaaatcaaacaacaaaatgaaagaaatcaacaggaaaatcaaatctctgctattaggaatcattaacaaacgtcagaaagcaatggaagaaggcgaagctggtcaatctgatttgttaggcatactaatggaatcgaattccaacgaaattcaaggagaaggaaacaataaggaggacggtatgtctatagaagatgtaatcgaggaatgcaaggttttctatataggtggacaagagactacagccagactattaatttggacaatgatacttttaagttcacatacggaatggcaagagagagcaaggactgaagtcttgaaagtctttggcaataagaagcctgattttgatggcttgaacagattgaaaatcgttagtgaaattctatag

SEQ ID NO: 888 - protein, 384 aa, Artificial Sequence
  Pathway step 3 sequence R CYP92A458 Protein
MEMSSCVAATISIWMVVVCIVGVGWRVVNWVWLRPKKLEKRLREQGLAGNSYRLLFGDLKERAAMAEQANSKPINFSHDIGPRVFPSMYKTIQNYGKNSYMWLGPYPRVHIMDPQQLKTVFTLVYDIQKPNLNPLVKFLLDGIVTHEGEKWAKHRKIINPAFHLEKLKDMIPAFFHSCNEIVNEWERLISKEGSCELDVMPYLQNLAADAISRTAFGSSYEEGKMIFQLLKELTDLVVKVAFGVYIPGWRFLPTKSNNKMKEINRKIKSLLLGIINKRQKAMEEGEAGQSDLLGILMESNSNEIQGEGNNKEDGMSIEDVIEECKVFYIGGQETTARLLIWTMILLSSHTEWQERARTEVLKVFGNKKPDFDGLNRLKIVSEIL

SEQ ID NO: 889 - protein, 493 aa, Artificial Sequence
  Pathway step 3 sequence S CYP88D6 Protein
MEVHWVCMCAATLLVCYIFGSKFVRNLNGWYYDVKLRRKEHPLPPGDMGWPLMGNLLSFIKDFSSGHPDSFINNLVLKYGRSGIYKTHLFGNPSIIVCEPQMCRRVLTDDVNFKLGYPKSIKELARCRPMIDVSNAEHRLFRRLITSPIVGHKALAMYLERLEEIVINSLEELSSMKHPVELLKEMKKVSFKAIVHVFMGSSNQDIIKKIGSSFTDLYNGMFSIPINVPGFTFHKALEARKKLAKIVQPVVDERRLMIENGQQEGDQRKDLIDILLEVKDENGRKLEDEDISDLLIGLLFAGHESTATSLMWSITYLTQHPHILKKAKEEQEEIMRTRLSSQKQLSFKEIKQMVYLSQVIDETLRCANIAFATFREATADVNINGYIIPKGWRVLIWARAIHMDSEYYPNPEEFNPSRWDDYNAKAGTFLPFGAGSRLCPGADLAKLEISIFLHYFLLNYRLERVNPECHVTSLPVSKPTDNCLAKVMKVSCA

SEQ ID NO: 890 - DNA, 1482 bp, Artificial Sequence
  Pathway step 3 sequence T CYP88D6 (codon optimized)
atggaagtacattgggtttgcatgtgcgctgccactttgttggtatgctacatttttggaagcaagtttgtgaggaatttgaatgggtggtattatgatgtaaaactaagaaggaaagaacacccactacccccaggtgacatgggatggcctcttatgggcaatctattgtccttcatcaaagatttctcatcgggtcaccctgattcattcatcaacaaccttgttctcaaatatggacgaagtggtatctacaagactcacttgtttgggaatccaagcatcattgtttgcgagcctcagatgtgtaggcgagttctcactgatgatgtgaactttaagcttggttatccaaaatctatcaaagagttggcacgatgtagacccatgattgatgtctctaatgcggaacataggctttttcgacgcctcattacttccccaatcgtgggtcacaaggcgctagcaatgtacctagaacgtcttgaggaaattgtgatcaattcgttggaagaattgtccagcatgaagcaccccgttgagctcttgaaagagatgaagaaggtttcctttaaagccattgtccacgttttcatgggctcttccaatcaggacatcattaaaaaaattggaagttcgtttactgatttgtacaatggcatgttctctatccccattaacgtacctggttttacattccacaaagcactcgaggcacgtaagaagctagccaaaatagttcaacccgttgtggatgaaaggcggttgatgatagaaaatggtcaacaagaaggggaccaaagaaaagatcttattgatattcttttggaagtcaaagatgagaatggacgaaaattggaggacgaggatattagcgatttattaatagggcttttgtttgctggccatgaaagtacagcaaccagtttaatgtggtcaattacatatcttacacagcatccccatatcttgaaaaaggctaaggaagagcaggaagaaataatgaggacaagattgtcctcgcagaaacaattaagttttaaggaaattaaacaaatggtttatctttctcaggtaattgatgaaactttacgatgtgccaatattgcctttgcaacttttcgagaggcaactgctgatgtgaacatcaatggttatatcataccaaagggatggagagtgctaatttgggcaagagccattcatatggattctgaatattacccaaatccagaagaatttaatccatcgagatgggatgattacaatgccaaagcaggaaccttccttccttttggagcaggaagtagactttgtcctggagccgacttggcgaaacttgaaatttccatatttcttcattatttcctccttaattacaggttggagcgagtaaatccagaatgtcatgttaccagcttaccagtatctaagcccacagacaattgcctcgctaaggtgatgaaggtctcatgtgcttag

SEQ ID NO: 891 - DNA, 1563 bp, Artificial Sequence
  Pathway step 4 sequence U CYP1798 (codon optimized)
atggaaatgtcctcttctgttgctgccaccatttctatttggatggttgttgtatgtatcgttggtgttggttggagagttgttaattgggtttggttaagaccaaagaagttggaaaagagattgagagaacaaggtttggctggtaactcttacagattgttgttcggtgacttgaaagaaagagctgctatggaagaacaagctaactctaagccaatcaacttctcccatgatattggtccaagagttttcccatctatgtacaagaccattcaaaactacggtaagaactcctatatgtggttgggtccatacccaagagttcatattatggatccacaacaattgaaaaccgtctttaccttggtttacgacatccaaaagccaaacttgaacccattgatcaagttcttgttggatggtattgtcacccatgaaggtgaaaaatgggctaaacatagaaagattatcaacccagccttccacttggaaaagttgaaagatatgattccagccttcttccactcttgcaacgaaatagttaatgaatgggaaagattgatctccaaagaaggttcttgcgaattggatgttatgccatacttgcaaaatttggctgctgatgctatttctagaactgcttttggttcctcttacgaagaaggtaagatgatcttccaattattgaaagaattgaccgacttggttgttaaggttgctttcggtgtttacattccaggttggagatttttgccaactaagtccaacaacaagatgaaggaaatcaacagaaagatcaagtctttgttgttaggtatcatcaacaagagacaaaaggccatggaagaaggtgaagctggtcaatctgatttgttgggtattttgatggaatccaactccaacgaaattcaaggtgaaggtaacaacaaagaagatggtatgtccatcgaagatgttatcgaagaatgcaaggttttctacatcggtggtcaagaaactaccgccagattattgatttggaccatgatcttgttgagttcccatactgaatggcaagaaagagcaagaactgaagtcttgaaggttttcggtaacaaaaagccagatttcgacggtttgtctagattgaaggttgtcaccatgattttgaacgaagttttgagattatacccaccagcttctatgttgaccagaatcattcaaaaagaaaccagagtcggtaagttgactttgccagctggtgttattttgatcatgccaatcatcttgatccacagagatcatgatttgtggggtgaagatgctaatgaattcaagccagaaagattctccaagggtgtttctaaagctgctaaagttcaaccagctttctttccatttggttggggtccaagaatatgtatgggtcaaaatttcgctatgatcgaagctaagatggccttgtctttgatcttgcaaagattttccttcgaattgtcctcctcatatgttcatgctccaactgttgttttcaccactcaaccacaacatggtgctcatatcgttttgagaaagttgtaa

SEQ ID NO: 892 - protein, 520 aa, Artificial Sequence; identical to SEQ ID NO: 20
  Pathway step 4 sequence V CYP1798 Protein

SEQ ID NO: 893 - DNA, 951 bp, Artificial Sequence; identical to SEQ ID NO: 115
  Pathway step 4 sequence W EPH2A (codon optimized)

SEQ ID NO: 894 - protein, 316 aa, Artificial Sequence; identical to SEQ ID NO: 30
  Pathway step 3 sequenceID X step 44 EPH2A Protein

SEQ ID NO: 895 - DNA, 4113 bp, Artificial Sequence
  Pathway step 7 sequence Y tDexT DNA (native DNA sequence)
atgccagcaaatgccccagataaacaatcagtgactaatgcaccagtagtgccgccaaagcatgatacggaccagcaggacgattcactagaaaaacagcaagtattagaaccgagcgtaaatagtaatataccaaaaaagcagacaaatcaacagttagcggttgttacagcaccagcaaattcagcacctcaaaccaaaacaacagcagaaatttctgctggtacagagttagacacgatgcctaatgttaagcatgtagatggcaaagtttatttttatggagatgatggccaaccaaaaaagaattttactactattatagatggtaaaccttactactttgataaagatacaggggcactatctaataacgataagcaatatgtatcggaattattcagtattggcaataaacataacgccgtctataacacatcatcagataattttacgcaattagaaggacatctgacggcaagtagttggtatcgtccaaaagatattttgaaaaatggtaaacgttgggcaccttcaacagtgactgatttcagaccattattgatggcctggtggccggataagagtacgcaagtcacttatctgaattacatgaaagatcagggcctcttgtctggtactcatcacttttccgataatgaaaatatgcggaccttaacggcagctgccatgcaggcacaggtaaacattgagaaaaaaattgggcaacttggcaatacggattggttgaaaacggcgatgacgcaatacattgatgcccagcccaattggaatattgacagtgaggcgaaaggagatgatcatctacaaggtggtgcactactttatacaaatagtgatatgtcgccaaaggccaattctgattatcgtaagctgagccgtacgcctaaaaatcaaaaaggtcaaattgctgataaatataagcaaggtgggtttgaattattactagcaaacgatgtcgataattctaatccagttgtgcaagcagaacaacttaattggttacattatatgatgaatatcggtagtattttacaaaatgatgaccaagctaattttgatggttaccgtgttgatgctgtcgataatgtggacgctgacttactacagattgctggtgaatatgctaaggctgcctatggtgttgacaaaaatgacgcgagagcgaatcaacatttatcaattttggaagactggggagatgaagatccagactatgtcaaagcacatggcaaccagcaaattacaatggatttccccttgcatttagcgattaaatacgcgctcaacatgcctaatgataagcggagtggccttgagccaacccgtgaacacagtttagtcaaacgaattacagatgataaagaaaatgttgcacaaccaaattattcatttatccgagctcatgacagtgaagtacaaacgattattgctgatattattaaagataaaatcaacccggcgtcaacagggctagattcaacagtgactttggatcaaattaagcaggcttttgacatctataatgctgatgaattgaaagcagataaagtttacacaccttacaatattccagcatcatacgctttgttattgactaataaagacacaattccacgtgtttattatggggatatgttcacggatgatggccaatacatggctaaacaatcaccttactatcaagcgattgatgcgttgttgaaagctcgtatcaagtatgctgctggtggtcaaaccatgaaaatgaactattttccagatgaacaatctgttatgacatcagttcgttatggtaagggtgcaatgacggcaagtgactctggtaaccaagagacacgctatcaaggtattggacttgttgtcaacaatcgcccagatttgaaactatctgacaaagatgaagtcaaaatggatatgggtgcggcacataaaaaccaagattatcgcccagttttgttgacgacaaaatcaggattaaaagtctacagcactgatgcaaatgcacctgtcgttcgaactgacgccaatggccaattaacttttaaggcagacatggtatatggtgtaaacgacccacaagtgtcagggtacattgcggcttgggtaccagtaggggcttcagaaaatcaagatgctcgaacgaaaagtgaaacaacgcagtcaactgacgggagtgtttatcattctaatgcagcgttagattcgcaagtcatttatgaaggcttttcaaattttcaagactttccaacaacacccgatgagtttacgaacattaaaattgctcaaaatgttaacttatttaaggattggggtattactagctttgaaatggcgccacaatatcgcgccagctcagataaaagtttcttagatgctatcgtacaaaatggttatgcatttacagatcgatatgatattggttacaacacaccaacaaagtatgggacagcagataatttgttagatgctttacgtgcattgcatggtcagggtattcaagcgattaacgactgggtaccagatcaaatttataatctacccgatgaacagttagtcacggctattcgaacagacggttcaggtgatcatacttatggttcagttattgaccatactttgtatgcatcaaagacagttggcgggggcatttatcagcaacaatatggtggggccttcttggaacaattaaaaacacagtacccgcaacttttccagcaaaaacagatttccacagatcagccaatgaacccagatattcaaattaagtcatgggaagccaagtatttcaacggttcgaacattcaggggcgtggggcttggtatgttttgaaggactggggcacacaacagtattttaatgtgtcagatgcgcagaccttccttccaaagcaattattgggtgaaaaggccaaaactggttttgttacgcgtggtaaggagacttcattctattccactagtggctatcaagcaaaatctgcctttatttgtgataacggtaattggtactactttgatgacaaagggaaaatggttgttggaaaccaagttatcaatggcatcaattattactttttaccgaatggtatcgaattacaagatgcctatctagtacatgatggtatgtactattattataataatattggcaagcaactgcacaacacatattaccaagataaacaaaaaaatttccattacttctttgaagatgggcacatggcacagggtattgtcaccatcattcaaagtgatggcaccccagtcacacagtactttgatgagaatggtaagcaacaaaaaggcgtggcggtcaaaggatcagatggtcatttgcattactttgacggtgcgtcagggaatatgctctttaaatcatggggtagactagcagatggctcttggctatatgtagacgagaaaggtaatgcggttacaggcaaacaaaccattaataatcaaacggtttactttaatgatgatggtcgtcaaatcaaaaataactttaaagaattagcagatggttcttggctttatcttaacaataaaggtgttgcagtaacaggagagcaaataattaatgggcagacactttattttggtaacgatggtcgtcaatttaaagggacaacacatataaatgctactggtgaaagccgttactatgacccagactcaggtaatatgataactgatcgttttgaacgtgttggtgataatcaatgggcttattttggttatgatggtgttgcagtaacaggggaccgaatcattaaagggcaaaaactctatttcaaccaaaatggtatccaaatgaaaggccacttacgtcttgaaaatggtatcatgcgttattacgatgctgatactggcgaattagttcgtaatcgatttgtattgctatctgatggttcatgggtttactttggccaagatggcgtacccgtaactggcgtgcaagtgattaatggccaaacattatattttgacgcagatggtaggcaagtcaaagggcagcaacgtgtaatcggcaatcaacgctattggatggataaagacaatggtgaaatgaaaaaaataacatactag

SEQ ID NO: 896 - protein, 1370 aa, Artificial Sequence
  Pathway step 7 sequence Z tDexT Protein
MPANAPDKQSVTNAPVVPPKHDTDQQDDSLEKQQVLEPSVNSNIPKKQTNQQLAVVTAPANSAPQTKTTAEISAGTELDTMPNVKHVDGKVYFYGDDGQPKKNFTTIIDGKPYYFDKDTGALSNNDKQYVSELFSIGNKHNAVYNTSSDNFTQLEGHLTASSWYRPKDILKNGKRWAPSTVTDFRPLLMAWWPDKSTQVTYLNYMKDQGLLSGTHHFSDNENMRTLTAAAMQAQVNIEKKIGQLGNTDWLKTAMTQYIDAQPNWNIDSEAKGDDHLQGGALLYTNSDMSPKANSDYRKLSRTPKNQKGQIADKYKQGGFELLLANDVDNSNPVVQAEQLNWLHYMMNIGSILQNDDQANFDGYRVDAVDNVDADLLQIAGEYAKAAYGVDKNDARANQHLSILEDWGDEDPDYVKAHGNQQITMDFPLHLAIKYALNMPNDKRSGLEPTREHSLVKRITDDKENVAQPNYSFIRAHDSEVQTIIADIIKDKINPASTGLDSTVTLDQIKQAFDIYNADELKADKVYTPYNIPASYALLLTNKDTIPRVYYGDMFTDDGQYMAKQSPYYQAIDALLKARIKYAAGGQTMKMNYFPDEQSVMTSVRYGKGAMTASDSGNQETRYQGIGLVVNNRPDLKLSDKDEVKMDMGAAHKNQDYRPVLLTTKSGLKVYSTDANAPVVRTDANGQLTFKADMVYGVNDPQVSGYIAAWVPVGASENQDARTKSETTQSTDGSVYHSNAALDSQVIYEGFSNFQDFPTTPDEFTNIKIAQNVNLFKDWGITSFEMAPQYRASSDKSFLDAIVQNGYAFTDRYDIGYNTPTKYGTADNLLDALRALHGQGIQAINDWVPDQIYNLPDEQLVTAIRTDGSGDHTYGSVIDHTLYASKTVGGGIYQQQYGGAFLEQLKTQYPQLFQQKQISTDQPMNPDIQIKSWEAKYFNGSNIQGRGAWYVLKDWGTQQYFNVSDAQTFLPKQLLGEKAKTGFVTRGKETSFYSTSGYQAKSAFICDNGNWYYFDDKGKMVVGNQVINGINYYFLPNGIELQDAYLVHDGMYYYYNNIGKQLHNTYYQDKQKNFHYFFEDGHMAQGIVTIIQSDGTPVTQYFDENGKQQKGVAVKGSDGHLHYFDGASGNMLFKSWGRLADGSWLYVDEKGNAVTGKQTINNQTVYFNDDGRQIKNNFKELADGSWLYLNNKGVAVTGEQIINGQTLYFGNDGRQFKGTTHINATGESRYYDPDSGNMITDRFERVGDNQWAYFGYDGVAVTGDRIIKGQKLYFNQNGIQMKGHLRLENGIMRYYDADTGELVRNRFVLLSDGSWVYFGQDGVPVTGVQVINGQTLYFDADGRQVKGQQRVIGNQRYWMDKDNGEMKKITY

SEQ ID NO: 897 - DNA, 1584 bp, Artificial Sequence
  Step 1 sequence id A tHMG-CoA DNA
atggcagctgaccaattggtgaaaactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaaaggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgttgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccgcatgctaccgctcctggtaccaacgcacgtcaattagcaagaatagttgcctgtgccgtcttggcaggtgaattatccttatgtgctgccctagcagccggccatttggttcaaagtcatatgacccacaacaggaaacctgctgaaccaacaaaacctaacaatttggacgccactgatataaatcgtttgaaagatgggtccgtcacctgcattaaatcctaa

SEQ ID NO: 898 - protein, 527 aa, Artificial Sequence
  Step 1 sequence id B tHMG-CoA Protein
MAADQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 899 - DNA, 1491 bp, Artificial Sequence; identical to SEQ ID NO: 335
  Step 1 sequence id C erg1 DNA

SEQ ID NO: 900 - protein, 496 aa, Artificial Sequence; identical to SEQ ID NO: 50
  Step 1 sequence id D erg1 protein

SEQ ID NO: 901 - DNA, 2325 bp, Artificial Sequence
  Pathway 2 sequence id E Cmelo DNA
atgtggagattaaaagtgggaaaagagagtgttggggaaaaagaagagaaatggattaagagtataagcaatcacttgggacgtcaagtttgggaattttgcagtggtgaaaatgaaaatgatgatgatgaagccattgctgttgctaataattctgcttcaaagttcgagaatgccaggaatcactttcgtaataatcgtttccatcgcaagcaatcttccgacctctttcttgccattcagtgtgaaaaggaaataataagaaacggtgcaaaaaatgaaggaaccaccaaagtaaaagaaggggaagatgtgaagaaagaagcagtgaagaatacattagaaagagcattaagtttctattcggctgttcaaacaagcgatgggaattgggcttcggatcttggcgggcctatgtttttactaccgggtttagtgattgctctatatgtcactggagtcttgaattctgttctgtccaagcaccatcgccaagaaatgtgtagatatatttacaatcatcagaatgaagatgggggatggggtttgcacattgaaggttcgagcacgatgtttggttcggcactgaattatgttgcactgagactgcttggagaggctgccgatggcggagagcacggcgcaatgacaaaagctcgaagttggatcttggagcgtggtggagctaccgcaatcacttcttggggaaaattgtggctgtcagtacttggagtctatgaatggagtggcaacaatcctctcccacctgaattttggttactcccatatagcctaccatttcatcctggaagaatgtggtgccattgtcgaatggtttatctaccaatgtcgtacttatatggaaagagatttgttgggccaatcacacccatagttttatctctaagaaaagagctttacacaattccatatcatgaaattgattggaatagatctcgcaatacatgtgcaaaggaggatttgtactatccacatccgaagatgcaagatattttatggggatcgatataccacgtgtatgagccattgtttagtggttggccagggaaaaggttgagggaaaaggcaatgaaaattgcaatggaacatatacattatgaagatgaaaatagtcgatatatatgtcttggtcctgtcaataaagtacttaatatgctttgttgttgggttgaagatccttattcagatgccttcaaatttcatctacaaagaatccctgactatctttggcttgctgaagatggcatgagaatgcagggttacaatgggagtcaattgtgggacactgctttctctattcaagcaattatatccaccaaacttatagacacctttggcccaaccttaagaaaagcacatcattttgttaaacactctcagatccaggaggactgtcctggtgatcctaacgtttggttccgtcacattcataaaggtgcttggcctttttcaactcgagatcatggttggctcatctctgactgtacggccgagggactaaaggcttctttgatgttatccaaacttccatccaaaatagttggggagccattagaaaagaatcgcctttgtgatgctgttaatgttctcctttctttacaaaacgaaaatggtggatttgcatcatacgagttgacaagatcatacccttggttggagttgatcaaccctgcagaaacatttggagatatcgtcatcgattattcgtatgtggagtgcacctcagcgacaatggaagcattggcattgtttaagaagttacatccagggcataggaccaaagagattgatgctgctattgccaaggccgccaactttcttgaaaatatgcaaaagactgatggctcttggtatggatgttggggggtatgcttcacatatgcagggtggtttgggataaagggattggttgctgcaggaagaacatataataactgtgttgcaattcgtaaggcttgtaattttcttttatctaaagagttacctggtggtggatggggggagagttacctttcatgtcagaataaggtctacaccaatcttgaaggaaacaaaccacacttggttaatactgcttgggtaatgatggctctcattgaagctggccagggtgagagagacccagccccattgcatcgtgcagcaagattattaatcaattctcaattggagagtggtgattttccccaacaggagatcatgggagtgtttaataaaaactgtatgattacatatgctgcataccgaaacatttttcccatttgggctcttggagagtattcccatagagttttggatatgtaa

SEQ ID NO: 902 - protein, 774 aa, Artificial Sequence; identical to SEQ ID NO: 329
  Pathway 2 sequence id F Cmelo Protein

SEQ ID NO: 903 - DNA, 2271 bp, Artificial Sequence
  Pathway 2 sequence id G PSXY118L DNA (codon optimized)
atgtggaaacttaaagttgctgagggtggcactccatggttaagaaccctaaacaatcacgtgggtagacaggtttgggagtttgacccacattctggttctcctcaagacttggacgatattgagacagcaagaagaaatttccatgacaatcgtttcactcataaacactcagacgacttacttatgagattgcagtttgccaaagaaaaccccatgaatgaagtactgcctaaggttaaggttaaagacgttgaagatgtcacagaagaagcagttgctaccactctaagaagaggcttgaacttctacagcaccatacaatcccacgatggtcattggcccggtgatttgggtggtcctatgttcttgatgcctggtttagttatcactttgtccgttactggggctcttaacgctgttttaaccgatgaacatagaaaagagatgagaagatacttatacaatcaccaaaacaaagatggaggctggggcttgcatattgaaggtcctagtacgatgtttggttcagtgttatgctatgttaccttgagactattgggtgaagggccaaatgatggtgagggtgacatggagagaggaagagattggatcctagaacatggtggagcaacatatataacctcttggggcaaaatgtggttatctgtattgggcgtgtttgaatggtcagggaacaatccaatgccaccagaaatttggttgttgccttatgctcttccagttcatccaggaagaatgtggtgtcattgtaggatggtttacttaccgatgtcgtacttatacggaaaacgttttgtcggtcctattacaccgaccgtgcttagtcttaggaaagagctatttacagtaccgtatcatgatatagactggaaccaagcaagaaatttatgtgccaaagaagatttatattaccctcatccactagtgcaggatatattatgggctacacttcacaagtttgtcgaacccgtctttatgaattggcctggtaagaagctaagggaaaaggcgatcaaaacagcaattgagcacattcattatgaggatgagaatactaggtatatctgcattgggcccgtcaacaaagtgttgaatatgctgtgttgttgggtggaagatcctaattccgaagctttcaaactgcatttgccgagaatttatgattacctatgggtagctgaagatggcatgaaaatgcaaggttataacggatcgcaattgtgggatacagcatttgctgcacaagccattattagcacaaatctaattgacgaattcggacccacgttaaagaaggcgcacgccttcattaagaatagtcaagtatccgaagattgtcctggtgatctgagcaaatggtacagacacatctcaaaaggtgcttggccattttctactgccgatcatggctggccaattagcgactgtactgcggaagggcttaaggcagtattgttattatcgaagatagcacctgagattgttggagaaccattggattccaagcgtttgtatgatgcagttaatgtaattctgtcactgcagaacgaaaatggaggtttggcgacttacgaattgactagatcatatacgtggctggaaataatcaaccctgccgaaacgtttggtgacatagtcatagattgtccatatgttgaatgcacaagtgctgccattcaggctctagcaacttttggtaaattgtatccaggtcatcgtcgtgaagaaatacaatgttgcatagagaaagccgttgccttcatcgagaagattcaagcttctgatggttcttggtatggatcatggggcgtctgttttacctacgggacgtggtttggtatcaagggtttgattgctgcagggaagaatttctccaattgcttaagtataaggaaagcgtgtgagttcttactgtctaaacaattgccaagtggtggatgggccgaatcttacttgtcttgtcagaacaaagtgtactctaacttagaaggaaataggtcgcacgtcgttaatacaggatgggctatgcttgcattgattgaagcagagcaagctaagagagatccaactccactacatagagcagccgtatgcttaatcaactcacaacttgaaaatggcgactttccgcaagaagaaatcatgggcgtattcaataagaactgtatgataacttacgctgcgtataggtgcatctttcccatttgggctttgggtgaatatagaagagtcttacaagcttgctag

SEQ ID NO: 904 - protein, 756 aa, Artificial Sequence; identical to SEQ ID NO: 341
  Pathway 2 sequence id H PSXY118L Protein

SEQ ID NO: 905 - DNA, 2112 bp, Artificial Sequence
  Pathway 2 sequence id I DdCASY80L DNA (codon optimized)
atgaccacgacaaactggtccctaaaggtagacagagggcgtcaaacttgggaatactctcaagaaaagaaggaggccactgatgtggacatccatttgctacgactgaaggaacccggcacacattgccctgaaggttgtgatctgaatcgcgctaaaactccccaacaagcgattaagaaagcatttcagtacttctccaaagtccaaacagaagatggtcattgggctggagatttgggtgggccaatgttcttgttacccggtttggtgataacatgctacgttactggctatcaattgccagaatccactcaaagggaaattataaggtatctgttcaatagacagaatccggttgatggtggctggggtttgcatatagaggcccactctgatatatttggaactacgttacaatatgtatcattgagattacttggagttccagccgaccatccatctgttgtaaaggcaagaaccttcttattacagaatggtggagcaaccggtattccttcatggggtaaattctggttggccacgttgaatgcatacgactggaacgggttgaatccaattcctattgaattttggctgttaccctacaacttacccattgctcctggtaggtggtggtgtcactgtcggatggtctatctcccaatgtcttatatctacgctaagaaaacaactggtccactaacagatttggtcaaggatctgaggagagaaatctattgtcaagagtacgaaaagattaactggtctgaacaaagaaacaatatttcgaaattagacatgtactacgagcatacatctcttttaaatgttataaacggatcattgaatgcttacgagaaagttcattccaaatggcttagggataaagccattgactatacctttgaccatatacgctatgaagatgagcagacgaaatacattgacataggtccagtcaataagaccgtcaatatgttatgcgtttgggatagagaaggcaaatctcctgcgttttacaaacatgccgatcgacttaaagattatctatggttatctttcgatgggatgaaaatgcaaggctataacggttctcaattgtgggacactgcttttacgatccaagcattcatggaatctgggattgccaatcaattccaggattgtatgaaattagctggtcactatttggacatctcccaggtaccagaagatgccagagatatgaagcactaccacagacactattcgaagggtgcatggccttttagtaccgttgaccatggatggccaatttcagattgcacagcagaaggtatcaagtcagcgcttgctctcagatctttgccttttatcgaaccaatatccttagatagaattgctgatggcattaatgttctattaaccttgcaaaatggggatggtggatgggcatcgtacgagaacacaagaggaccgaaatggctggaaaagtttaacccttccgaagttttccagaatataatgattgactatagctatgtggaatgtagtgctgcttgtattcaagctatgagtgcgtttcgtaaacatgcacctaatcatccaagaattaaggaaatcaacagatctattgcacgtggagtgaaatttatcaagagcattcaacgtcaggatggttcatggctgggcagttggggaatttgttttacctacggtacttggtttggcatagagggcttagtagcatctggtgagcctctaacatcgccatcgatcgtgaaggcttgcaagtttcttgcgtcaaaacaacgtgcagatggtggttggggagaaagctttaaaagcaatgtgactaaagaatatgttcaacacgaaacttcacaagtagtcaatactggttgggctctactcagtctaatgagtgctaaatatccggacagagagtgcatagagagaggtatcaaattcttaatacagaggcaatatccgaacggtgattttccacaggaatccattattggcgttttcaattttaactgtatgatctcatattcaaactataagaacatattccctctttgggccttgagtaggtataatcaattgtaccttaaaagcaaaatctga

SEQ ID NO: 906 - protein, 703 aa, Artificial Sequence
  Pathway 2 sequence id J DdCASY80L protein
MTTTNWSLKVDRGRQTWEYSQEKKEATDVDIHLLRLKEPGTHCPEGCDLNRAKTPQQAIKKAFQYFSKVQTEDGHWAGDLGGPMFLLPGLVITCYVTGYQLPESTQREIIRYLFNRQNPVDGGWGLHIEAHSDIFGTTLQYVSLRLLGVPADHPSVVKARTFLLQNGGATGIPSWGKFWLATLNAYDWNGLNPIPIEFWLLPYNLPIAPGRWWCHCRMVYLPMSYIYAKKTTGPLTDLVKDLRREIYCQEYEKINWSEQRNNISKLDMYYEHTSLLNVINGSLNAYEKVHSKWLRDKAIDYTFDHIRYEDEQTKYIDIGPVNKTVNMLCVWDREGKSPAFYKHADRLKDYLWLSFDGMKMQGYNGSQLWDTAFTIQAFMESGIANQFQDCMKLAGHYLDISQVPEDARDMKHYHRHYSKGAWPFSTVDHGWPISDCTAEGIKSALALRSLPFIEPISLDRIADGINVLLTLQNGDGGWASYENTRGPKWLEKFNPSEVFQNIMIDYSYVECSAACIQAMSAFRKHAPNHPRIKEINRSIARGVKFIKSIQRQDGSWLGSWGICFTYGTWFGIEGLVASGEPLTSPSIVKACKFLASKQRADGGWGESFKSNVTKEYVQHETSQVVNTGWALLSLMSAKYPDRECIERGIKFLIQRQYPNGDFPQESIIGVFNFNCMISYSNYKNIFPLWALSRYNQLYLKSKI

SEQ ID NO: 907 - DNA, 2325 bp, Artificial Sequence
  Pathway 2 sequence id K Cmelo DNA (codon optimized)
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 908 - DNA, 1587 bp, Artificial Sequence
  Step 1 sequence id L SQE1 DNA (codon optimized)
atggtcgatcaatgtgcgttaggctggatattagctagtgcactaggattggttatcgctctatgcttcttcgttgcaccaagaagaaaccacagaggtgttgatagcaaagaaagggatgagtgtgtgcagtctgcagccacaactaagggcgaatgcagatttaacgatagagatgtggatgttattgtggttggtgcaggagtagctggttcggcattagcccatacacttggtaaagacggtagaagagttcatgtcattgagagggatttgactgaaccagacaggattgttggtgaacttctacaaccaggaggctatttgaagttgattgagttaggcttacaagactgtgtggaagaaatagatgcacaaagagtttacgggtatgctttgtttaaagatggtaagaacaccagactatcttatccacttgaaaattttcactcagatgtctccggtagaagctttcacaacggtagattcattcagaggatgagagaaaaggctgcttcgctgccaaatgtaagattggaacaagggacggttactagtctactggaagagaaagggacgatcaaaggagttcagtataagtccaagaatggagaggagaaaaccgcgtatgcgcctttaacgatagtgtgtgatggctgtttctctaacttacgtagatcattatgtaatcccatggttgacgttccgagctactttgttggtcttgtgttagaaaattgcgaactgccatttgccaatcatggacatgttatccttggtgatccatccccaatcttattctatcagatctcaagaaccgaaattaggtgtttggtcgatgtacccggtcaaaaggtcccttcaattgccaatggcgaaatggagaaatatttaaagactgttgtagctccacaagtaccacctcagatttacgacagttttatagccgccattgacaaagggaatatcagaactatgcctaataggtctatgcctgcagctccccatccaactccaggtgcgttactgatgggcgatgcattcaacatgagacatcctctaacaggaggtggcatgacagtagcactgtctgacattgtggtcttgagaaacttgttaaaaccgttaaaagacttgtctgacgcctctactttgtgcaaatacttggaatccttttatacccttcgtaaaccagtagctagcacaatcaacaccttagctggagccttgtacaaagtcttttgcgcatcaccggatcaagcgagaaaggaaatgagacaagcttgttttgattacctaagtctgggaggtattttctcgaatggtcctgtctcattgttgtcagggttgaatcccagacctttatccttggtattgcacttcttcgctgtcgcaatttatggtgttggtcgtttgcttctaccttttccaagtgttaagggtatatggattggtgcaaggttgatctactctgcctctggtataatatttcccataattagagctgaaggcgttcgtcaaatgttctttcctgctacagtgcccgcttactatcgttccccacctgtatttaaaccgatagtgtag

SEQ ID NO: 909 - protein, 528 aa, Artificial Sequence
  Step 1 sequence id M  SQE1 Protein
MVDQCALGWILASALGLVIALCFFVAPRRNHRGVDSKERDECVQSAATTKGECRFNDRDVDVIVVGAGVAGSALAHTLGKDGRRVHVIERDLTEPDRIVGELLQPGGYLKLIELGLQDCVEEIDAQRVYGYALFKDGKNTRLSYPLENFHSDVSGRSFHNGRFIQRMREKAASLPNVRLEQGTVTSLLEEKGTIKGVQYKSKNGEEKTAYAPLTIVCDGCFSNLRRSLCNPMVDVPSYFVGLVLENCELPFANHGHVILGDPSPILFYQISRTEIRCLVDVPGQKVPSIANGEMEKYLKTVVAPQVPPQIYDSFIAAIDKGNIRTMPNRSMPAAPHPTPGALLMGDAFNMRHPLTGGGMTVALSDIVVLRNLLKPLKDLSDASTLCKYLESFYTLRKPVASTINTLAGALYKVFCASPDQARKEMRQACFDYLSLGGIFSNGPVSLLSGLNPRPLSLVLHFFAVAIYGVGRLLLPFPSVKGIWIGARLIYSASGIIFPIIRAEGVRQMFFPATVPAYYRSPPVFKPIV

SEQ ID NO: 910 - DNA, 1575 bp, Artificial Sequence
  Step 1 sequence id N SQE2 DNA (codon optimized)
atggtcgatcaatgcgcgttaggctggatattagcttccgtcctaggagctgcagcgttgtatttcttgtttggtagaaagaatggtggtgtgtctaatgaaagaaggcatgaaagtattaagaacattgcaactaccaatggtgagtataagtcaagtaactccgatggtgacatcatcattgttggtgctggcgttgctggatctgctttggcctatacgctaggtaaagatgggagaagagtgcatgtcattgaaagggatttgacagaaccagaccgtatagtaggtgaattgttacaaccaggagggtatctaaaactgacagagttgggtttagaagattgtgtggatgatatagatgctcaacgtgtttatgggtatgcattattcaaagacggtaaagataccagattgtcctatcccttggaaaagtttcactctgacgtcgcaggcagatcctttcataatggcagattcattcagcgtatgagagagaaagctgcttcattgcctaaagtgagcctagagcaagggactgtaacgtcactgttggaggaaaacggaataatcaaaggggtacagtataaaactaagactggtcaagagatgactgcatatgctcctttaacaatcgtctgtgacggctgcttttcgaaccttcgtagaagcttgtgcaacccaaaagtcgatgttccctcatgttttgtgggattagttctagaaaattgcgatttgccttacgccaatcacggacatgtgatcttggctgatccgtcacctattctgttctacagaatatctagtaccgaaatcaggtgtttggttgatgttccaggtcagaaagtgccttctatcagtaatggcgaaatggccaactacttgaagaatgttgttgcacctcagattccaagccaactttacgactcttttgttgcagccattgacaagggaaacataagaacaatgccgaatagatctatgccagcagatccatatccaacacccggtgcgctgctaatgggtgatgcctttaacatgagacatcctctaacaggtggtggtatgacagtcgctttatcggatgttgtcgtattaagagacttactgaaaccacttagagacttgaatgatgcacctaccttgagcaagtatttagaagccttttacactctgcgtaagcctgttgcttctaccataaacacgttagcaggagcattgtacaaggtattctgtgcttctcctgatcaagcgagaaaggaaatgagacaagcctgttttgactacctttcacttggtggcatattcagtaatggaccagtatccttattgtcaggtcttaatccaaggcccatttcccttgttttacacttctttgcagtggctatctatggtgttggaaggctattaataccgtttccatcaccgaaaagggtatggattggtgctagaattatttcgggcgcgagtgcaattattttccccattatcaaagctgaaggcgtcagacaaatgttctttccagccactgtagctgcctactacagagccccaagagttgttaaaggtaggtag

SEQ ID NO: 911 - protein, 524 aa, Artificial Sequence
  Step 1 sequence id O SQE2 Protein
MVDQCALGWILASVLGAAALYFLFGRKNGGVSNERRHESIKNIATTNGEYKSSNSDGDIIIVGAGVAGSALAYTLGKDGRRVHVIERDLTEPDRIVGELLQPGGYLKLTELGLEDCVDDIDAQRVYGYALFKDGKDTRLSYPLEKFHSDVAGRSFHNGRFIQRMREKAASLPKVSLEQGTVTSLLEENGIIKGVQYKTKTGQEMTAYAPLTIVCDGCFSNLRRSLCNPKVDVPSCFVGLVLENCDLPYANHGHVILADPSPILFYRISSTEIRCLVDVPGQKVPSISNGEMANYLKNVVAPQIPSQLYDSFVAAIDKGNIRTMPNRSMPADPYPTPGALLMGDAFNMRHPLTGGGMTVALSDVVVLRDLLKPLRDLNDAPTLSKYLEAFYTLRKPVASTINTLAGALYKVFCASPDQARKEMRQACFDYLSLGGIFSNGPVSLLSGLNPRPISLVLHFFAVAIYGVGRLLIPFPSPKRVWIGARIISGASAIIFPIIKAEGVRQMFFPATVAAYYRAPRVVKGR

SEQ ID NO: 912 - DNA, 1572 bp, Artificial Sequence
  Step 1 sequence id P SQE3 DNA (codon optimized)
atggaattccaatcggaacccttgtttggggttctgttggctagtcttttagcgctggttttcttctttactttgagagatggtaccaagaacaagaaaaccacaactgggtcatctgtggatctgaaacgtactgacgctgtcctacaaatgtctcccgaaaacgatgctagaaggcaggaaatcataggggattcagacgtgattgtagtaggtgcaggagttgcaggagctgcattagcctatacgttgggcaaagatggtagaaaagttcacgtaattgaaagagacttgacagagccagatagaattgtaggtgaactattacaacctggtggctacttgaagctagtggagttgggtcttgaagatagtgttaaaggtattgacgctcaacaagtctttggatatgcgttgtataaggacggtaaacacacaagacttacgtatcctttggaaaagttcgactcaactgtatcaggcagatccttccataatggcagattcatccaaagattaagggaatctgtgagactagaacaaggaactgttaccagcatcttagaagaggatggaacagttaaaggtgttcagtataagacgaaaattggagaggagtttacagcttatgcaccattgacaatcgtctgtgatggcgggtttagtaacttgagaagaaatttatgcaaaccacaaatcgacattccctcgtgttttgtgggattagttttggaaaactgcaaacttcccttcgagaatcatggccatgtagtactggcagatccgtcacctattctgttatacccgattagttcaacggaaattcgttgtttggttgacattccaggtcagaaagtgccctcagtagccaatggcgaaatggccagatacttaaagactgttgtcgctccgcaagttccacctgaactacatgctgcctttatagcggctatagagaaaggtaatatcaagagcacaactaacagatctatgccagcagcacctcacccaacacctggcgccctgttgctaggtgatgcattcaatatgagacatcccttaaccggtggtggtatgactgttgccttagcggacattgttgtgcttagagatttgttgcgtcctcttgctaatctaaaggatgctgatgccttgtgtcactatctagagtccttttacacccttcgtaaacctgtcgcatccaccataaacacattagctggcgcattatacaaggtcttttgtgcctctccagattctgctagaaaggaaatgagggaagcatgttttgattacctgagtttaggtggtgtcttttcgtctggacctgtagctttgttatccggtttgaatccaagacctttgtccttattttgccatttctttgcagtggccatatatggagtttctaggttgcttataccattcccaagcccaatgaggatttggattggtgttagattaatcactgttgcggccggtataatatttccgattatcaaagctgaaggggtcagacagatgttctttcctgctactgtcccagcttattacagggcaccaccaatgtag

SEQ ID NO: 913 - protein, 523 aa, Artificial Sequence
  Step 1 sequence id Q SQE3 Protein
MEFQSEPLFGVLLASLLALVFFFTLRDGTKNKKTTTGSSVDLKRTDAVLQMSPENDARRQEIIGDSDVIVVGAGVAGAALAYTLGKDGRKVHVIERDLTEPDRIVGELLQPGGYLKLVELGLEDSVKGIDAQQVFGYALYKDGKHTRLTYPLEKFDSTVSGRSFHNGRFIQRLRESVRLEQGTVTSILEEDGTVKGVQYKTKIGEEFTAYAPLTIVCDGGFSNLRRNLCKPQIDIPSCFVGLVLENCKLPFENHGHVVLADPSPILLYPISSTEIRCLVDIPGQKVPSVANGEMARYLKTVVAPQVPPELHAAFIAAIEKGNIKSTTNRSMPAAPHPTPGALLLGDAFNMRHPLTGGGMTVALADIVVLRDLLRPLANLKDADALCHYLESFYTLRKPVASTINTLAGALYKVFCASPDSARKEMREACFDYLSLGGVFSSGPVALLSGLNPRPLSLFCHFFAVAIYGVSRLLIPFPSPMRIWIGVRLITVAAGIIFPIIKAEGVRQMFFPATVPAYYRAPPM

SEQ ID NO: 914 - skipped

SEQ ID NO: 915 - DNA, 2400 bp, Artificial Sequence
  SS3e-E7 Full gene NT Seq Full gene NT Seq
atgtccgaaaatcacgttcctgccgttgtcaaaacgcgtggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 916 - protein, 799 aa, Artificial Sequence
  SS3e-E7 Full Gene AA seq
MSENHVPAVVKTRGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 917 - protein, 13 aa, Artificial Sequence
  SS3e-E7 Fusion AA seq
MSENHVPAVVKTR

SEQ ID NO: 918 - skipped

SEQ ID NO: 919 - DNA, 2403 bp, Artificial Sequence
  SS3d-G5 Full gene NT Seq
atgacgacccagcaagaggagctcgatgttggagacagtgagggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 920 - protein, 800 aa, Artificial Sequence
  SS3d-G5 Full Gene AA seq
MTTQQEELDVGDSEGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 921 - protein, 14 aa, Artificial Sequence
  SS3d-G5 Fusion AA seq
MTTQQEELDVGDSE

SEQ ID NO: 922 - skipped

SEQ ID NO: 923 - DNA, 2391 bp, Artificial Sequence
  SS3c-G8 Full gene NT Seq
atggaggacggtaaacaggccatcagcgagggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 924 - protein, 796 aa, Artificial Sequence
  SS3c-G8 Full Gene AA seq
MEDGKQAISEGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 925 - protein, 10 aa, Artificial Sequence
  SS3c-G8 Fusion AA seq
MEDGKQAISE

SEQ ID NO: 926 - skipped

SEQ ID NO: 927 - DNA, 2394 bp, Artificial Sequence
  SS3c-E5 Full gene NT Seq
atgacgatcggtgataagctgaaaaagaagcttggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 928 - protein, 797 aa, Artificial Sequence
  SS3c-E5Full Gene AA seq
MTIGDKLKKKLGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 929 - protein, 11 aa, Artificial Sequence
  SS3c-E5 Fusion AA seq
MTIGDKLKKKL

SEQ ID NO: 930 - skipped

SEQ ID NO: 931 - DNA, 2382 bp, Artificial Sequence
  SS2c-E2Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgatgttggagccgtcaccctaa

SEQ ID NO: 932 - protein, 793 aa, Artificial Sequence
  SS2c-E2 Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMMLEPSP

SEQ ID NO: 933 - protein, 7 aa, Artificial Sequence
  SS2c-E2 Fusion AA seq
MMLEPSP

SEQ ID NO: 934 - skipped

SEQ ID NO: 935 - DNA, 2394 bp, Artificial Sequence; identical to SEQ ID NO: 866
  SS2c-A10b Full gene NT Seq

SEQ ID NO: 936 - protein, 797 aa, Artificial Sequence; identical to SEQ ID NO: 869
  SS2c-A10b Full Gene AA seq

SEQ ID NO: 937 - protein, 10 aa, Artificial Sequence
  SS2c-A10b Fusion AA seq
MNSNEDIIPE

SEQ ID NO: 938 - skipped

SEQ ID NO: 939 - DNA, 2388 bp, Artificial Sequence
  SS3b-C1 Full gene NT Seq
atgtggaacaaaaccaaaaaaacacaaggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 940 - protein, 795 aa, Artificial Sequence
  SS3b-C1 Full Gene AA seq
MWNKTKKTQGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 941 - protein, 9 aa, Artificial Sequence
  SS3b-C1 Fusion AA seq
MWNKTKKTQ

SEQ ID NO: 942 - skipped

SEQ ID NO: 943 - DNA, 2394 bp, Artificial Sequence
  SS3b-B10 Full gene NT Seq
atggccaaagaagatactgtaaaactaaaaaggggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 944 - protein, 797 aa, Artificial Sequence
  SS3b-B10 Full Gene AA seq
MAKEDTVKLKRGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 945 - protein, 11 aa, Artificial Sequence
  SS3b-B10 Fusion AA seq
MAKEDTVKLKR

SEQ ID NO: 946 - skipped

SEQ ID NO: 947 - DNA, 2391 bp, Artificial Sequence
  SS3a-D8 Full gene NT Seq
atgtcatttcaaattgaaacggttcgtactggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 948 - protein, 796 aa, Artificial Sequence
  SS3a-D8Full Gene AA seq
MSFQIETVRTGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 949 - protein, 10 aa, Artificial Sequence
  SS3a-D8 Fusion AA seq
MSFQIETVRT

SEQ ID NO: 950 - skipped

SEQ ID NO: 951 - DNA, 2400 bp, Artificial Sequence
  SS3a-A2 Full gene NT Seq
atgaccggcttgaatggagatgctgacagcgatctactaggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 952 - protein, 799 aa, Artificial Sequence
  SS3a-A2 Full Gene AA seq
MTGLNGDADSDLLGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 953 - protein, 13 aa, Artificial Sequence
  SS3a-A2 Fusion AA seq
MTGLNGDADSDLL

SEQ ID NO: 954 - skipped

SEQ ID NO: 955 - DNA, 2394 bp, Artificial Sequence
  SS3f-A8 Full gene NT Seq
atggcaagtaaccagctcgagcccctgcaaactggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 956 - protein, 797 aa, Artificial Sequence
  SS3f-A8 Full Gene AA seq
MASNQLEPLQTGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 957 - protein, 11 aa, Artificial Sequence
  SS3f-A8 Fusion AA seq
MASNQLEPLQT

SEQ ID NO: 958 - skipped

SEQ ID NO: 959 - protein, 2391 aa, Artificial Sequence
  SS4b-B8a Full gene NT Seq
ATGTGGAGACTGAAAGTAGGCAAAGAATCTGTTGGCGAAAAGGAAGAAAAGTGGATTAAAAGCATTAGTAACCATTTGGGCAGACAAGTCTGGGAGTTTTGCTCTGGTGAAAATGAAAACGACGACGATGAAGCAATTGCTGTAGCTAACAATTCAGCCTCAAAATTTGAAAATGCAAGAAATCACTTCCGTAATAACAGATTCCATAGGAAGCAATCTTCCGACTTATTCTTGGCTATACAATGCGAGAAAGAGATCATTAGGAATGGTGCTAAGAATGAAGGTACTACCAAAGTGAAAGAAGGTGAAGATGTTAAGAAAGAAGCCGTAAAAAATACACTAGAAAGAGCATTGTCGTTCTATTCTGCTGTACAGACCTCTGACGGTAATTGGGCATCAGACTTGGGAGGACCTATGTTCCTTTTACCAGGGCTAGTTATTGCGCTATACGTTACAGGCGTTCTTAACAGTGTGTTGTCAAAACATCACAGGCAAGAAATGTGTCGTTACATCTATAATCACCAAAACGAAGATGGAGGGTGGGGTTTACATATAGAAGGCTCTTCTACTATGTTTGGGTCTGCACTGAATTACGTTGCGTTAAGGTTACTAGGAGAAGCGGCAGATGGCGGTGAGCATGGTGCGATGACCAAAGCAAGGTCCTGGATATTGGAAAGAGGAGGTGCCACAGCAATAACTTCCTGGGGCAAACTTTGGCTTTCCGTATTAGGAGTGTATGAATGGTCGGGAAACAATCCATTGCCACCCGAATTTTGGTTACTTCCATATAGCCTTCCCTTTCATCCAGGGAGAATGTGGTGTCATTGTAGAATGGTTTATCTGCCAATGTCGTATCTTTATGGTAAGAGATTTGTTGGTCCAATCACTCCAATAGTTTTATCGTTGAGAAAAGAGTTATATACCATTCCGTACCACGAGATTGATTGGAATAGATCCAGAAACACGTGTGCTAAGGAGGACTTATATTACCCTCACCCTAAGATGCAAGATATCCTATGGGGCAGTATCTACCATGTCTACGAACCGCTATTTTCAGGTTGGCCAGGTAAGAGATTGAGGGAAAAGGCCATGAAAATTGCAATGGAACATATCCATTACGAAGATGAGAATTCCAGGTACATATGCCTTGGACCCGTGAACAAAGTTCTAAATATGCTGTGTTGCTGGGTTGAGGATCCTTACTCTGATGCTTTCAAGTTTCACTTGCAGAGAATTCCTGACTATCTATGGTTAGCTGAAGATGGAATGAGAATGCAGGGTTATAATGGTTCACAGCTTTGGGACACTGCATTCAGCATACAAGCGATAATCTCAACGAAATTGATTGATACGTTTGGTCCGACATTACGTAAAGCACACCATTTCGTCAAGCATAGTCAGATTCAAGAGGATTGTCCAGGTGATCCAAACGTATGGTTCAGACACATTCATAAAGGAGCTTGGCCTTTTAGCACTAGAGATCATGGTTGGCTTATATCGGATTGCACAGCTGAGGGATTGAAAGCTTCACTGATGTTATCTAAGTTGCCTTCTAAAATTGTGGGTGAACCCTTGGAGAAGAACCGTTTATGTGATGCAGTCAATGTTTTGTTATCATTGCAAAACGAAAATGGTGGGTTCGCTTCTTATGAATTAACTAGGTCCTATCCCTGGTTAGAGTTGATTAACCCTGCCGAAACATTTGGTGATATCGTAATTGACTACAGTTATGTGGAATGCACTAGTGCGACGATGGAAGCCTTAGCCTTGTTTAAGAAGTTGCACCCTGGGCATAGAACCAAAGAAATTGATGCCGCTATTGCTAAAGCCGCAAATTTTCTGGAGAATATGCAGAAAACAGACGGGTCTTGGTATGGTTGTTGGGGTGTCTGTTTTACTTATGCTGGTTGGTTTGGCATCAAAGGCTTAGTAGCTGCTGGTAGAACATACAATAATTGTGTTGCCATTAGAAAGGCTTGTAACTTCCTGTTGTCAAAAGAATTGCCTGGCGGTGGTTGGGGCGAAAGCTACCTAAGTTGCCAAAACAAAGTTTATACCAATCTGGAGGGAAACAAGCCACACTTAGTCAATACTGCATGGGTCATGATGGCCTTGATTGAAGCAGGACAAGGGGAAAGAGATCCAGCTCCGTTGCATAGAGCTGCCAGATTGCTAATCAATAGTCAATTGGAGTCAGGTGACTTTCCACAACAAGAAATCATGGGTGTGTTTAATAAGAACTGTATGATAACATATGCCGCATACAGAAACATATTCCCTATATGGGCTCTAGGTGAATACTCCCATCGTGTCTTGGATATGGGAAGTGCAGCTCCTGGAAGTGGAAGTGGTTCAGGAATGAATTTAGATTTAGATCAAGATTCAGACTAG

SEQ ID NO: 960 - protein, 796 aa, Artificial Sequence
  SS4b-B8a Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMNLDLDQDSD

SEQ ID NO: 961 - protein, 10 aa, Artificial Sequence
  SS4b-B8a Fusion AA seq
MNLDLDQDSD

SEQ ID NO: 962 - skipped

SEQ ID NO: 963 - DNA, 3387 bp, Artificial Sequence
  SS4b-B8b Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgataaaacatatagtttcgccattcaggacgaattttgttggcatcagcaagtccgtgctgtcaaggatgattcatcacaaggttacaatcataggttctggccccgctgcccacaccgctgctatatacttggcaagagcagagatgaagcccacattatatgagggaatgatggccaacggaattgctgctggtggccaattgacaacaaccaccgatatcgaaaatttcccagggtttcctgaatcgttgagtggcagtgaactgatggagaggatgaggaaacaatctgccaagtttggcactaacataattatcgagactgtctctaaagtcgatttatcttcaaaaccattcagattatggaccgaatttaatgaggatgcagagcctgtgaccactgatgctataatcttggccacgggtgcttccgctaagagaatgcatttaccaggggaggaaacctactggcagcagggaatatctgcctgtgctgtatgtgatggtgcagtccctatctttagaaacaagccattggccgttattggtggtggtgactctgcgtgtgaggaagcggaatttcttacgaagtatgcgtcgaaagtatatatattagtaagaaaggatcattttcgtgcatctgtaataatgcagagacgaattgagaaaaatccaaacatcattgttttgttcaacacagttgcattagaagctaagggtgatggtaagttattgaatatgttgagaattaagaatactaaaagtaatgtggagaacgatttagaagtaaatggactattttacgcaataggtcacagccctgccacagatatagttaaaggacaagtagatgaagaagagacggggtatataaaaactgtgcctggatcgtctctgacttctgtgccaggtttttttgctgcaggtgacgttcaggactctaggtatagacaagcagttacttctgctggttccggatgcattgctgctttggatgcagaacggtacctaagtgcccaagagtaa

SEQ ID NO: 964 - protein, 1128 aa, Artificial Sequence
  SS4b-B8b Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIIIETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVRKDHFRASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 965 - skipped

SEQ ID NO: 966 - DNA, 2389 bp, Artificial Sequence
  SS4b-D4 Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatggccgtacagaaccatatcttgcctctaa

SEQ ID NO: 967 - protein, 800 aa, Artificial Sequence
  SS4b-D4 Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMAVQNHILPLTRVM

SEQ ID NO: 968 - protein, 14 aa, Artificial Sequence
  SS4b-D4 Fusion AA seq
MAVQNHILPLTRVM

SEQ ID NO: 969 - skipped

SEQ ID NO: 970 - DNA, 2398 bp, Artificial Sequence
  SS4c-C4a Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgtctgcttcaactcattcgcctgaataaccgtgtctga

SEQ ID NO: 971 - protein, 798 aa, Artificial Sequence
  SS4c-C4a Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMSASTHSPEPCL

SEQ ID NO: 972 - protein, 9 aa, Artificial Sequence
  SS4c-C4a Fusion AA seq
MSASTHSPE

SEQ ID NO: 973 - skipped

SEQ ID NO: 974 - DNA, 3189 bp, Artificial Sequence
  SS4c-C4b Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatgggtactagcatagtaaatctaaaccaaaagattgaactgcccccaatccaggtcttattcgagtcacttaaccgagaaaatgaaacaaaaccccacttcgaggaacgcaggttatatcaacctaatccttcatttgttcctagaacaaatatagcagttggtagcccagttaacccggttccagtatcatcccctgtttttttcattggtccttctccacagagaagcattcagaatcacaacgctattatgactcaaaacatacgtcagtatccagttatatataataataaccgagaagttatatctacgggtgagagaaattacataataactgtaggggggcctccggtaacttcttcgcagcccgagtatgagcatatctcaactcccaatttctatcaagagcagagactggcacaacctcatccggtaaatgagagtatgatgataggtggttatacaaatcctcagcctattagcatttcccgaggtaaaatgctatccggcaacataagtacgaactcggtccgcggatctaataatggatattccgcaaaagaaaaaaaacataaggcacatggtaagaggtccaatttaccaaaggccaccgtttcaattctaaacaaatggttacatgagcacgtaaacaacccttacccaaccgtgcaggaaaaaagagaactgctcgcgaaaactggtctaactaaacttcaaatttccaattggttcattaatgctaggagaagaaaaatattttctggccagaatgacgcaaataatttcagaagaaaattcagttcttctacaaatttagctaagttctga

SEQ ID NO: 975 - protein, 1062 aa, Artificial Sequence
  SS4c-C4b Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMGTSIVNLNQKIELPPIQVLFESLNRENETKPHFEERRLYQPNPSFVPRTNIAVGSPVNPVPVSSPVFFIGPSPQRSIQNHNAIMTQNIRQYPVIYNNNREVISTGERNYIITVGGPPVTSSQPEYEHISTPNFYQEQRLAQPHPVNESMMIGGYTNPQPISISRGKMLSGNISTNSVRGSNNGYSAKEKKHKAHGKRSNLPKATVSILNKWLHEHVNNPYPTVQEKRELLAKTGLTKLQISNWFINARRRKIFSGQNDANNFRRKFSSSTNLAKF

SEQ ID NO: 976-977 - skipped (2 entries)

SEQ ID NO: 978 - DNA, 2386 bp, Artificial Sequence
  SS4e-B2 Full gene NT Seq
atgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgggaagtgcagctcctggaagtggaagtggttcaggaatggaccagccaaggaccatttaagtaa

SEQ ID NO: 979 - protein, 794 aa, Artificial Sequence
  SS4e-B2 Full Gene AA seq
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDMGSAAPGSGSGSGMDQPRTIV

SEQ ID NO: 980 - protein, 7 aa, Artificial Sequence
  SS4e-B2 Fusion AA seq
MDQPRTI

SEQ ID NO: 981 - skipped

SEQ ID NO: 982 - DNA, 2391 bp, Artificial Sequence
  SS5a-E8 Full gene NT Seq
atgactacggataacgcagcagcatattcaggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 983 - protein, 796 aa, Artificial Sequence
  SS5a-E8 Full Gene AA seq
MTTDNAAAYSGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 984 - protein, 10 aa, Artificial Sequence
  SS5a-E8 Fusion AA seq
MTTDNAAAYS

SEQ ID NO: 985 - skipped

SEQ ID NO: 986 - DNA, 2397 bp, Artificial Sequence
  SS5d-E7 Full gene NT Seq
atggctctcggtaatgagatagccaacttgcaagagggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 987 - protein, 798 aa, Artificial Sequence
  SS5d-E7 Full Gene AA seq
MALGNEIANLQEGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 988 - protein, 12 aa, Artificial Sequence
  SS5d-E7 Fusion AA seq
MALGNEIANLQE

SEQ ID NO: 989 - skipped

SEQ ID NO: 990 - DNA, 2427 bp, Artificial Sequence
  SS5d-G5 Full gene NT Seq
atgccagtctctgtaataaccacgtcaacacagccacatgtgaaggagcctgtggaagaagagagtggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 991 - protein, 808 aa, Artificial Sequence
  SS5d-G5 Full Gene AA seq
MPVSVITTSTQPHVKEPVEEESGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 992 - protein, 22 aa, Artificial Sequence
  SS5d-G5 Fusion AA seq
MPVSVITTSTQPHVKEPVEEES

SEQ ID NO: 993 - skipped

SEQ ID NO: 994 - DNA, 2397 bp, Artificial Sequence
  SS5d-G7 Full gene NT Seq
atgtcatcgagcaagaaaatcaccagtgtcaaacaaggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 995 - protein, 798 aa, Artificial Sequence
  SS5d-G7 Full Gene AA seq
MSSSKKITSVKQGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 996 - protein, 12 aa, Artificial Sequence
  SS5d-G7 Fusion AA seq
MSSSKKITSVKQ

SEQ ID NO: 997 - skipped

SEQ ID NO: 998 - DNA, 2382 bp, Artificial Sequence
  SS5e-C10 Full gene NT Seq
atgcgaggcttgacacctaagggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 999 - protein, 793 aa, Artificial Sequence
  SS5e-C10 Full Gene AA seq
MRGLTPKGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 1000 - protein, 7 aa, Artificial Sequence
  SS5e-C10 Fusion AA seq
MRGLTPK

SEQ ID NO: 1001 - skipped

SEQ ID NO: 1002 - DNA, 2385 bp, Artificial Sequence
  SS5e-G8 Full gene NT Seq
atggcaaaccaaatagcaaatcaaggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 1003 - protein, 794 aa, Artificial Sequence
  SS5e-G8 Full Gene AA seq
MANQIANQGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 1004 - protein, 8 aa, Artificial Sequence
  SS5e-G8 Fusion AA seq
MANQIANQ

SEQ ID NO: 1005 - skipped

SEQ ID NO: 1006 - DNA, 2385 bp, Artificial Sequence
  SS5f-E11 Full gene NT Seq
atggttgacgctaggggtagcaacggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 1007 - protein, 794 aa, Artificial Sequence
  SS5f-E11 Full Gene AA seq
MVDARGSNGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 1008 - protein, 8 aa, Artificial Sequence
  SS5f-E11 Fusion AA seq
MVDARGSN

SEQ ID NO: 1009 - skipped

SEQ ID NO: 1010 - DNA, 2388 bp, Artificial Sequence
  SS5f-F8 Full gene NT Seq
atgcacggcaaagagttggctgggctaggaagtgcagctcctggaagtggaagtggttcaggaatgtggagactgaaagtaggcaaagaatctgttggcgaaaaggaagaaaagtggattaaaagcattagtaaccatttgggcagacaagtctgggagttttgctctggtgaaaatgaaaacgacgacgatgaagcaattgctgtagctaacaattcagcctcaaaatttgaaaatgcaagaaatcacttccgtaataacagattccataggaagcaatcttccgacttattcttggctatacaatgcgagaaagagatcattaggaatggtgctaagaatgaaggtactaccaaagtgaaagaaggtgaagatgttaagaaagaagccgtaaaaaatacactagaaagagcattgtcgttctattctgctgtacagacctctgacggtaattgggcatcagacttgggaggacctatgttccttttaccagggctagttattgcgctatacgttacaggcgttcttaacagtgtgttgtcaaaacatcacaggcaagaaatgtgtcgttacatctataatcaccaaaacgaagatggagggtggggtttacatatagaaggctcttctactatgtttgggtctgcactgaattacgttgcgttaaggttactaggagaagcggcagatggcggtgagcatggtgcgatgaccaaagcaaggtcctggatattggaaagaggaggtgccacagcaataacttcctggggcaaactttggctttccgtattaggagtgtatgaatggtcgggaaacaatccattgccacccgaattttggttacttccatatagccttccctttcatccagggagaatgtggtgtcattgtagaatggtttatctgccaatgtcgtatctttatggtaagagatttgttggtccaatcactccaatagttttatcgttgagaaaagagttatataccattccgtaccacgagattgattggaatagatccagaaacacgtgtgctaaggaggacttatattaccctcaccctaagatgcaagatatcctatggggcagtatctaccatgtctacgaaccgctattttcaggttggccaggtaagagattgagggaaaaggccatgaaaattgcaatggaacatatccattacgaagatgagaattccaggtacatatgccttggacccgtgaacaaagttctaaatatgctgtgttgctgggttgaggatccttactctgatgctttcaagtttcacttgcagagaattcctgactatctatggttagctgaagatggaatgagaatgcagggttataatggttcacagctttgggacactgcattcagcatacaagcgataatctcaacgaaattgattgatacgtttggtccgacattacgtaaagcacaccatttcgtcaagcatagtcagattcaagaggattgtccaggtgatccaaacgtatggttcagacacattcataaaggagcttggccttttagcactagagatcatggttggcttatatcggattgcacagctgagggattgaaagcttcactgatgttatctaagttgccttctaaaattgtgggtgaacccttggagaagaaccgtttatgtgatgcagtcaatgttttgttatcattgcaaaacgaaaatggtgggttcgcttcttatgaattaactaggtcctatccctggttagagttgattaaccctgccgaaacatttggtgatatcgtaattgactacagttatgtggaatgcactagtgcgacgatggaagccttagccttgtttaagaagttgcaccctgggcatagaaccaaagaaattgatgccgctattgctaaagccgcaaattttctggagaatatgcagaaaacagacgggtcttggtatggttgttggggtgtctgttttacttatgctggttggtttggcatcaaaggcttagtagctgctggtagaacatacaataattgtgttgccattagaaaggcttgtaacttcctgttgtcaaaagaattgcctggcggtggttggggcgaaagctacctaagttgccaaaacaaagtttataccaatctggagggaaacaagccacacttagtcaatactgcatgggtcatgatggccttgattgaagcaggacaaggggaaagagatccagctccgttgcatagagctgccagattgctaatcaatagtcaattggagtcaggtgactttccacaacaagaaatcatgggtgtgtttaataagaactgtatgataacatatgccgcatacagaaacatattccctatatgggctctaggtgaatactcccatcgtgtcttggatatgtga

SEQ ID NO: 1011 - protein, 795 aa, Artificial Sequence
  SS5f-F8 Full Gene AA seq
MHGKELAGLGSAAPGSGSGSGMWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 1012 - protein, 9 aa, Artificial Sequence
  SS5f-F8 Fusion AA seq
MHGKELAGL

SEQ ID NO: 1013 - protein, 448 aa, Artificial Sequence
  EXG1  YLR300W Saccharomyces cerevisiae
MLSLKTLLCTLLTVSSVLATPVPARDPSSIQFVHEENKKRYYDYDHGSLGEPIRGVNIGGWLLLEPYITPSLFEAFRTNDDNDEGIPVDEYHFCQYLGKDLAKSRLQSHWSTFYQEQDFANIASQGFNLVRIPIGYWAFQTLDDDPYVSGLQESYLDQAIGWARNNSLKVWVDLHGAAGSQNGFDNSGLRDSYKFLEDSNLAVTTNVLNYILKKYSAEEYLDTVIGIELINEPLGPVLDMDKMKNDYLAPAYEYLRNNIKSDQVIIIHDAFQPYNYWDDFMTENDGYWGVTIDHHHYQVFASDQLERSIDEHIKVACEWGTGVLNESHWTVCGEFAAALTDCTKWLNSVGFGARYDGSWVNGDQTSSYIGSCANNDDIAYWSDERKENTRRYVEAQLDAFEMRGGWIIWCYKTESSLEWDAQRLMFNGLFPQPLTDRKYPNQCGTISN

SEQ ID NO: 1014 - protein, 421 aa, Artificial Sequence
  EXG1 Yarrowia lipolytica
MKLTKLVALAGAALASPIQLVPREGSFLGFNYGSEKVHGVNLGGWFVLEPFITPSLFEAFGNNDANVPVDEYHYTAWLGKEEAEKRLTDHWNTWITEYDIKAIAENYKLNLVRIPIGYWAFSLLPNDPYVQGQEAYLDRALGWCRKYGVKAWVDVHGVPGSQNGFDNSGLRDHWDWPNADNVQHSINVINYIAGKYGAPEYNDIVVGIELVNEPLGPAIGMEVIEKYFQEGFWTVRHAGSDTAVVIHDAFQEKNYFNNFMTTEQGFWNVVLDHHQYQVFSPGELARNIDQHIAEVCNVGRQASTEYHWRIFGEWSAALTDCTHWLNGVGKGPRLDGSFPGSYYQRSCQGRGDIQTWSEQDKQESRRYVEAQLDAWEHGGDGWIYWTYKTENALEWDFRRLVDNGIFPFPYWDRQFPNQCGF

SEQ ID NO: 1015 - protein, 631 aa, Artificial Sequence
  Glugan 1, 4, alpha glucosidase
MPRLSYALCALSLGHAAIAAPQLSARATGSLDSWLGTETTVALNGILANIGADGAYAKSAKPGIIIASPSTSEPDYYYTWTRDAALVTKVLVDLFRNGNLGLQKVITEYVNSQAYLQTVSNPSGGLASGGLAEPKYNVDMTAFTGAWGRPQRDGPALRATALIDFGNWLIDNGYSSYAVNNIWPIVRNDLSYVSQYWSQSGFDLWEEVNSMSFFTVAVQHRALVEGSTFAKRVGASCSWCDSQAPQILCYMQSFWTGSYINANTGGGRSGKDANTVLASIHTFDPEAGCDDTTFQPCSPRALANHKVYTDSFRSVYAINSGIPQGAAVSAGRYPEDVYYNGNPWFLTTLAAAEQLYDAIYQWKKIGSISITSTSLAFFKDIYSSAAVGTYASSTSTFTDIINAVKTYADGYVSIVQAHAMNNGSLSEQFDKSSGLSLSARDLTWSYAAFLTANMRRNGVVPAPWGAASANSVPSSCSMGSATGTYSTATATSWPSTLTSGSPGSTTTVGTTTSTTSGTAAETACATPTAVAVTFNEIATTTYGENVYIVGSISELGNWDTSKAVALSASKYTSSNNLWYVSVTLPAGTTFEYKYIRKESDGSIVWESDPNRSYTVPAACGVSTATENDTWQ

SEQ ID NO: 1016 - protein, 378 aa, Artificial Sequence
  polygalacturonase 1 [Aspergillus aculeatus] CAE46193.1 GI:34366090
MHLNTTLLVSLALGAASVLASPAPPAITAPPTAEEIAKRATTCTFSGSNGASSASKSKTSCSTIVLSNVAVPSGTTLDLTKLNDGTHVIFSGETTFGYKEWSGPLISVSGSDLTITGASGHSINGDGSRWWDGEGGNGGKTKPKFFAAHSLTNSVISGLKIVNSPVQVFSVAGSDYLTLKDITIDNSDGDDNGGHNTDAFDIGTSTYVTISGATVYNQDDCVAVNSGENIYFSGGYCSGGHGLSIGSVGGRSDNTVKNVTFVDSTIINSDNGVRIKTNIDTTGSVSDVTYKDITLTSIAKYGIVVQQNYGDTSSTPTTGVPITDFVLDNVHGSVVSSGTNILISCGSGSCSDWTWTDVSVSGGKTSSKCTNVPSGASC

SEQ ID NO: 1017 - protein, 369 aa, Artificial Sequence
  polygalacturonase 2 [Aspergillus aculeatus] CAE46194.1 GI:34366092
MHSFQLLGLAAVGSVVSAAPTASRVSDLVKKSSSTCTFTSASEASETSSSCSNVVLSNIEVPAGETLDLSDAADGATITFEGTTSFGYEEWDGPLIRFGGKQLTITQSDGAVIDGDGSRWWDSEGTNGGKTKPKFMYVHDVEDSTIKGLQIKNTPVQAISVQATNVYLTDITIDNSDGDDNGGHNTDGFDISESTGVYISGATVKNQDDCIAINSGENILFTGGTCSGGHGLSIGSVGGRDDNTVKNVTISDSTVTDSANGVRIKTIYGDTGDVSEITYSNIQLSGITDYGIVIEQDYENGSPTGTPSTGVPITDVTVDGVTGSIEDDAVQVYILCGDGSCSDWTWSGVDITGGETSSDCENVPSGASC

SEQ ID NO: 1018 - protein, 384 aa, Artificial Sequence
  polygalacturonase 3 [Aspergillus aculeatus] CAE46195.1 GI:34366094
MVRQLALACGLLAAVAVQAAPAEPAHPMVTEAPDASLLHKRATTCTFSGSEGASKVSKSKTACSTIYLSALAVPSGTTLDLKDLNDGTHVIFEGETTFGYEEWEGPLVSVSGTDITVEGASGAVLNGDGSRWWDGEGGNGGKTKPKFFAAHDLTSSTIKSIYIENSPVQVFSIDGATDLTLTDITIDNTDGDTDDLAANTDGFDIGESTDITITGAKVYNQDDCVAINSGENIYFSASVCSGGHGLSIGSVGGRDDNTVKNVTFYDVNVLKSQQAIRIKAIYGDTGSISDITYHEIAFSDATDYGIVIEQNYDDTSKTPTTGVPITDFTLENVIGTCADDDCTEVYIACGSGACSDWSWSSVSVTGGKVSSKCLNVPSGISCDL

SEQ ID NO: 1019 - protein, 339 aa, Artificial Sequence
  Chain A, Crystal Structure Of Polygalacturonase From Aspergillus Aculeatus At Ph4.5 1IB4_A GI:15988280
ATTCTFSGSNGASSASKSKTSCSTIVLSNVAVPSGTTLDLTKLNDGTHVIFSGETTFGYKEWSGPLISVSGSDLTITGASGHSINGDGSRWWDGEGGNGGKTKPKFFAAHSLTNSVISGLKIVNSPVQVFSVAGSDYLTLKDITIDNSDGDDNGGHNTDAFDIGTSTYVTISGATVYNQDDCVAVNSGENIYFSGGYCSGGHGLSIGSVGGRSDNTVKNVTFVDSTIINSDNGVRIKTNIDTTGSVSDVTYKDITLTSIAKYGIVVQQNYGDTSSTPTTGVPITDFVLDNVHGSVVSSGTNILISCGSGSCSDWTWTDVSVSGGKTSSKCTNVPSGASC

SEQ ID NO: 1020 - protein, 339 aa, Artificial Sequence; identical to SEQ ID NO: 1019
  Chain B, Crystal Structure Of Polygalacturonase From Aspergillus Aculeatus At Ph4.5 1IB4_B GI:15988281

SEQ ID NO: 1021 - protein, 339 aa, Artificial Sequence; identical to SEQ ID NO: 1019
  Chain A, Polygalacturonase From Aspergillus Aculeatus 1IA5_A GI:15988279

SEQ ID NO: 1022 - protein, 378 aa, Artificial Sequence; identical to SEQ ID NO: 1016
  polygalacturonase precursor [Aspergillus aculeatus] 378 aa protein AAC23565.1 GI:3220207

SEQ ID NO: 1023 - protein, 562 aa, Artificial Sequence
  EXG2 YDR261C Saccharomyces cerevisiae
MPLKSFFFSAFLVLCLSKFTQGVGTTEKEESLSPLELNILQNKFASYYANDTITVKGITIGGWLVTEPYITPSLYRNATSLAKQQNSSSNISIVDEFTLCKTLGYNTSLTLLDNHFKTWITEDDFEQIKTNGFNLVRIPIGYWAWKQNTDKNLYIDNITFNDPYVSDGLQLKYLNNALEWAQKYELNVWLDLHGAPGSQNGFDNSGERILYGDLGWLRLNNTKELTLAIWRDMFQTFLNKGDKSPVVGIQIVNEPLGGKIDVSDITEMYYEAFDLLKKNQNSSDNTTFVIHDGFQGIGHWNLELNPTYQNVSHHYFNLTGANYSSQDILVDHHHYEVFTDAQLAETQFARIENIINYGDSIHKELSFHPAVVGEWSGAITDCATWLNGVGVGARYDGSYYNTTLFTTNDKPVGTCISQNSLADWTQDYRDRVRQFIEAQLATYSSKTTGWIFWNWKTEDAVEWDYLKLKEANLFPSPFDNYTYFKADGSIEEKFSSSLSAQAFPRTTSSVLSSTTTSRKSKNAAISNKLTTSQLLPIKNMSLTWKASVCALAITIAALCASL

SEQ ID NO: 1024 - DNA, 1425 bp, Citrullus lanatus
atgtggacaattttgttaggtttggctacgctagctatcgcttactacatacattgggttaacaagtggaaagattcaaaattcaatggggtattgccaccggggacgatggggcttccgttgatcggtgaaacgattcaacttagccgtccgtccgattccttagacgtccatccattcattcagagcaaggtcaaaagatatggcccgatcttcaaaacatgcttagctggtcgtccggtggtggtttcgactgacgccgaattcaatcactacatcatgctacaagagggtcgtgccgtggaaatgtggtacttggatactctttcaaaattcttcggtttagacacggagtggctgaaggcgctaggcctgatacataaatacatcaggtccatcactttgaaccacttcggagcggaatccttgcgtgaaaggtttcttcctaggatagaagaaagcgcgcgtgagactctacattattggtcgactcagccatctgtcgaggttaaggaatccgcagctgcaatggtgttcagaacatcaattgttaaaatgttctcggaagattcatcgaaattgctgactggtggtttaaccaagaaattcacaggtttgctaggtgggttcttgacattgccacttaacttaccgggaacgacctacaataaatgtataaaggacatgaaggaaatccaaaagaaacttaaggacattctggaagagagactagcaaagggtaccggtaatgatgaggactttcttggtcaagcaatcaaggacaaggagtcccagcagttcatctccgaagaattcatcattcaattactgttctctatttccttcgcttctttcgaaagcatatcaacgagtttaactctgattctaaagttccttgctgaccatccgcaagttgtcaaggaacttgaggctgagcacgaggcaatccaaaaggccagagccgatccagatggccctataacttgggaagagtataaaagcatgacgtttacattgaacgttatatcagagactttaagattgggttcagttacgccagctcttctaaggaagactaccaaagaaatccagatcaaaggttacaccattccagagggatggacggtcatgttggtcactgcctcgaggcaccgtgaccccgaagtgtacaaggatcccgatacgtttaatccttggcgttggaaggaattagactctattaccgttcagaagaactttatgccattcggtggtggcctacgtcactgtgcgggtgctgaatactcgaaggtatacctatgcacgttccttcatattctattcaccaaatatagatggacaaagttgaagggtggcaagatagctagagctcacatcctgcgtttcgaggatggtttgcatgtgaagtttaccccaaaggagtga

SEQ ID NO: 1025 - protein, 474 aa, Citrullus lanatus
MWTILLGLATLAIAYYIHWVNKWKDSKFNGVLPPGTMGLPLIGETIQLSRPSDSLDVHPFIQSKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQPSVEVKESAAAMVFRTSIVKMFSEDSSKLLTGGLTKKFTGLLGGFLTLPLNLPGTTYNKCIKDMKEIQKKLKDILEERLAKGTGNDEDFLGQAIKDKESQQFISEEFIIQLLFSISFASFESISTSLTLILKFLADHPQVVKELEAEHEAIQKARADPDGPITWEEYKSMTFTLNVISETLRLGSVTPALLRKTTKEIQIKGYTIPEGWTVMLVTASRHRDPEVYKDPDTFNPWRWKELDSITVQKNFMPFGGGLRHCAGAEYSKVYLCTFLHILFTKYRWTKLKGGKIARAHILRFEDGLHVKFTPKE

SEQ ID NO: 1026 - DNA, 1425 bp, Cucumis sativus
atgtggaccatcttgttgggtttagctactttggctattgcctactatatccactgggttaacaaatggaaggactctaagtttaacggtgttttgccaccaggtactatgggtttgccattgattggtgaaaccatccaattgtctagaccatccgattctttggatgttcatccattcattcagagaaaggtcaaaagatacggtccaattttcaagacttgtttggctggtagaccagttgttgtttctactgatgctgaattcaaccactacatcatgttgcaagaaggtagagctgttgaaatgtggtacttggatactctgtctaagtttttcggtttggataccgaatggttgaaagccttgggtttgattcataagtacatcaggtctatcaccttgaaccattttggtgctgaatccttgagagaaagattcttgcctagaattgaagaatccgctagagaaacattgcattactggtcaactcaaacctccgttgaagtaaaagaatctgctgctgctatggttttcagaacctctatcgttaagatgttctccgaggattcttctaagttgttgactgaaggtttgaccaagaagttcactggtttgttaggtggttttttgactctgccattgaatttgccaggtacaacttaccataagtgcatcaaggatatgaagcagatccagaagaagttgaaggacatcttggaagaaagattggctaagggtgttaagatcgacgaagattttttgggtcaagccatcaaggacaaagaatcccaacaattcatctccgaagaattcatcatccagctgttgttctctatttccttcgcttccttcgaatctatttctactaccttgaccttgatcctgaatttcttggctgatcatcctgatgtcgtcaaagaattggaagctgaacatgaagctattagaaaggctagagctgatccagatggtcctattacttgggaagagtacaagtctatgaacttcactttgaacgttatctgcgaaaccttgagattgggttctgttactccagctttgttgagaaagaccacaaaagagattcaaatcaagggctacactattcctgaaggttggactgttatgttggttactgcttctagacatagagatcctgaagtttacaaggatccagatacttttaatccctggcgttggaaagagttggattccattactatccaaaagaacttcatgccatttggtggtggtttgagacattgtgctggtgcagaatactctaaggtttacttgtgtactttcctgcacatcttgttcactaagtacagatggcgtaaattgaaaggtggtaaaattgctagagcccacatcttgagatttgaagatggtctgtacgttaacttcaccccaaaagaatga

SEQ ID NO: 1027 - protein, 474 aa, Cucumis sativus
MWTILLGLATLAIAYYIHWVNKWKDSKFNGVLPPGTMGLPLIGETIQLSRPSDSLDVHPFIQRKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQTSVEVKESAAAMVFRTSIVKMFSEDSSKLLTEGLTKKFTGLLGGFLTLPLNLPGTTYHKCIKDMKQIQKKLKDILEERLAKGVKIDEDFLGQAIKDKESQQFISEEFIIQLLFSISFASFESISTTLTLILNFLADHPDVVKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQKNFMPFGGGLRHCAGAEYSKVYLCTFLHILFTKYRWRKLKGGKIARAHILRFEDGLYVNFTPKE

SEQ ID NO: 1028 - DNA, 1425 bp, Cucumis melo
atgtggaccatactattagggctagccactttagccattgcctattacatacattgggtcaacaaatggaaggactcaaaattcaatggcgttttaccaccaggcactatgggcttgccgctgattggtgagaccattcagctttcaagaccatccgatagtttggacgtccaccccttcatccaaagtaaagttaaaaggtacgggccaatctttaaaacctgtcttgccggaagacctgtcgttgtgtccaccgatgcagaattcaatcactacatcatgcttcaagagggtcgtgccgtcgaaatgtggtacttagacacattatctaagttctttggcttagacactgagtggttgaaagctctaggtctgattcacaaatacatcagaagtatcactttgaatcacttcggtgccgaatccctgagagaaagatttctgcctagaatcgaagagagtgccagggagacgctgcattactggtcgactcagccatcagtagaggtaaaagagtcggctgcagcgatggtgttcaggacatcaattgtgaaaatgttctctgaggattcgtcaaagttattaacagctgggctgacgaagaaatttactggtctgttgggtggtttcttgacattgcccttaaacgttcccgggacaacgtaccacaaatgtattaaggacatgaaagagatacagaagaaactgaaggacatacttgaagagaggcttgcaaagggcgtatcaatcgatgaagacttccttggccaggcgattaaggacaaagaatctcagcagtttatctccgaagagtttatcattcagttactattttccatcagctttgcgagtttcgagtcgatctctaccactttgaccttgatcttgaacttcttagcggaccatcccgatgttgctaaagaattggaagctgagcacgaggcgattcgtaaggcgagggcagatcccgacggccccataacttgggaagagtacaaatcgatgaactttacgttaaatgtgatatgcgagactcttcgtcttggtagtgttacaccagctttgctacgtaagaccacgaaggagatacaaataaagggctacactattcctgagggctggacggttatgctagttacagccagtagacatagagatcccgaagtgtacaaggatcctgatacattcaatccatggagatggaaggaattggatagtatcaccatacagaggaacttcatgccatttggtggtggcctgaggcactgtgcgggtgcagaatactcgaaggtctatttgtgcacattcttacacatattgttcacgaagtacaggtggagaaagctgaaaggtggaaagatcgcgagagcccatattcttagattcgaagacggcttgtacgtgaacttcacgccaaaagaataa

SEQ ID NO: 1029 - protein, 474 aa, Cucumis melo
MWTILLGLATLAIAYYIHWVNKWKDSKFNGVLPPGTMGLPLIGETIQLSRPSDSLDVHPFIQSKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQPSVEVKESAAAMVFRTSIVKMFSEDSSKLLTAGLTKKFTGLLGGFLTLPLNVPGTTYHKCIKDMKEIQKKLKDILEERLAKGVSIDEDFLGQAIKDKESQQFISEEFIIQLLFSISFASFESISTTLTLILNFLADHPDVAKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQRNFMPFGGGLRHCAGAEYSKVYLCTFLHILFTKYRWRKLKGGKIARAHILRFEDGLYVNFTPKE

SEQ ID NO: 1030 - DNA, 1428 bp, Quercus suber
atgtggacaataggcttgtgcatcgtcgccgttttggttatatacttgagctatagactgaataagtggtccaaccccaagtgtaacgggatcctacccccagggtcaatgggtttgcccttaattggtgaaaccctgcagctaattgtaccctcgtattccctagacctgcatcctttcatcaagaagaaagcacaaaagtacggcccaatcttcaggacttcggtagcgggttcgccaatcgttgtttctatagatcccgaattcaaccattacatcgtaaagcaggaaggtagactggtcgagctgtggtatttagactccttcagtaagctattttctacggaaggtgaaaataagacgaacgcgattggggttgtgcataagtacatcaggtctatcgcattgaatcatttcggggtggacccactaaaggagaagttgttgccacaaatcgaagaatttgttgacaaggctttgcagacctggtccagtcaccctttggttgagatgaagcatgccgccagcgttatgatctttgacttttcagccaagctattcatttcatatgatgcagaaaacagccctatgaaaatgagtgaaaagttcaccaacattttgggcggattcatgtcattccccctgaacattccaggcaccacttatcacaagtgtctaaaggatagaaatgaagccctgagtatgttgcgtaagatctttaaagagcgtataaactcacccaaaaggcattttgaagatctgcttgaccaggccattaacgacacggacaaagaaaagtttcttcctgaggacttcataatcaacgtagtgttcggtttgttgtttgcttcattcgagtccatctcagctgccctgtcgcttatacttaacctattggctgagcaccctgcagttctacaggaactgacagacgaacacaaggctattctgaagaatagggaatctcctaattccattttgacttgggacgaatataaatcaatgacattcacgcaccaggttataaatgaggctttgaggctgggcggggtcgctccaggcttgctaagaaaggctttaaaggatatcgagttcaagggctatacgatccctgcgggctggacaatcatgttagtaaacagtgccattcagttaaacccaaatacatataaagacccacttgcctttaacccatggagatggaaggacttggactcgctattcgtgtccaagaacttcatgcccttcggcggcgggattcgtcaatgcgttggtgccgagtactcaaagacattccttgccacgttccttcacgttcttgtaacaaaatatagatggaccaaggtcaaaggtggtacaatcgtgcgtaacccgatcttggagttcactgatggcttgcacattaaattctctgccatctccaattga

SEQ ID NO: 1031 - protein, 475 aa, Quercus suber
MWTIGLCIVAVLVIYLSYRLNKWSNPKCNGILPPGSMGLPLIGETLQLIVPSYSLDLHPFIKKKAQKYGPIFRTSVAGSPIVVSIDPEFNHYIVKQEGRLVELWYLDSFSKLFSTEGENKTNAIGVVHKYIRSIALNHFGVDPLKEKLLPQIEEFVDKALQTWSSHPLVEMKHAASVMIFDFSAKLFISYDAENSPMKMSEKFTNILGGFMSFPLNIPGTTYHKCLKDRNEALSMLRKIFKERINSPKRHFEDLLDQAINDTDKEKFLPEDFIINVVFGLLFASFESISAALSLILNLLAEHPAVLQELTDEHKAILKNRESPNSILTWDEYKSMTFTHQVINEALRLGGVAPGLLRKALKDIEFKGYTIPAGWTIMLVNSAIQLNPNTYKDPLAFNPWRWKDLDSLFVSKNFMPFGGGIRQCVGAEYSKTFLATFLHVLVTKYRWTKVKGGTIVRNPILEFTDGLHIKFSAISN

SEQ ID NO: 1032 - DNA, 1425 bp, Cucurbita maxima
atgtggaccattgtcgtgggccttgcaacacttgccgtcgcttattacatccattggataaacaagtggaaagactccaagttcaatggggtcttgccacctggaaccatgggtttaccattaatcggagaaacccttcagttatccaggccttccgattctctagacgttcatccatttatcaagaagaaagtaaagaggtacggttctatctttaaaacctgtttggccggtcgtcccgttgttgtaagtacggacgccgaattcaacaattacataatgcttcaagaggggagagccgttgagatgtggtaccttgataccctatcgaagttcttcggtcttgatactgagtggcttaaagccttagggttcattcataagtacataagatccattacattgaaccactttggtgctgagtctctgagagagaggttcttaccgaggattgaagagtcagctaaggaaactttatgctactgggccactcagccttccgttgaggtgaaggactcagcagcggtcatggtctttcgtacctcgatggtcaaaatggtatcgaaagactcctcaaaattgttaactggtggactgactaagaaatttaccgggttgctaggtggcttcttaacgttgcccattaacgttccaggaacaacatacaataagtgtatgaaagacatgaaggaaattcaaaagaaattgagggagatcctggaaggcagattagcatcaggtgctggttcagacgaggatttcctaggacaggcggttaaggacaagggatcccagaagttcatttcagacgacttcataatccagttactgttctctatcagttttgcgagttttgagtccatcagtacaacccttacattaatccttaactatctagccgaccaccccgacgtcgtaaaagagcttgaggcggaacatgaggcaattaggaacgcgagagcagatcccgacggcccaatcacatgggaagagtataagtccatgaccttcactttgcacgtaatcttcgagaccctacgtttgggcagtgtgacaccagcattgttgagaaagactacgaaagagctgcaaattaatggttatactatcccggaaggttggacggtaatgttagtgaccgcaagccgtcatagggatcctgctgtttacaaagaccctcatacgttcaacccttggagatggaaggaattggacagtataacaatccagaagaacttcatgccatttggtggtggtcttcgtcactgtgctggagctgagtattccaaggtgtacttatgcactttcttgcatattttgtttactaaatacaggtggactaagttgaaaggcggcaaggttgcgcgtgcccatatattgtccttcgaggatggcttgcatatgaaattcacacctaaggaataa

SEQ ID NO: 1033 - protein, 474 aa, Cucurbita maxima
MWTIVVGLATLAVAYYIHWINKWKDSKFNGVLPPGTMGLPLIGETLQLSRPSDSLDVHPFIKKKVKRYGSIFKTCLAGRPVVVSTDAEFNNYIMLQEGRAVEMWYLDTLSKFFGLDTEWLKALGFIHKYIRSITLNHFGAESLRERFLPRIEESAKETLCYWATQPSVEVKDSAAVMVFRTSMVKMVSKDSSKLLTGGLTKKFTGLLGGFLTLPINVPGTTYNKCMKDMKEIQKKLREILEGRLASGAGSDEDFLGQAVKDKGSQKFISDDFIIQLLFSISFASFESISTTLTLILNYLADHPDVVKELEAEHEAIRNARADPDGPITWEEYKSMTFTLHVIFETLRLGSVTPALLRKTTKELQINGYTIPEGWTVMLVTASRHRDPAVYKDPHTFNPWRWKELDSITIQKNFMPFGGGLRHCAGAEYSKVYLCTFLHILFTKYRWTKLKGGKVARAHILSFEDGLHMKFTPKE

SEQ ID NO: 1034 - DNA, 1482 bp, Cucurbita pepo
atggagatcataaacggagtgttcctaatcttgcccctgggattcgtcctagtattcgaggtgcttaagagattgaatggcttgtactacgcggtaaaattggggaagaagtggggagaattaccaccaggcgacctatcctggcccttgttaggatctactctatccttcttgaagtcattcaccgtgggcccaccagaaagctttataaggatctttaccaccaggtacggcaaggtggacatgtacaagacccatatgttcggaagagcttcgattctggtatgcaaaccagaaatctgtcgtcaggttctgatagacgaaactaagttcgtcccctcgtaccccgcctgtatgaagagattgttcggccgtaaaagtttaatccgtgtatcgaaggccgagcatagaaagttgaggagaatgactatggctccaatcagttcacacgcggccttggagatctacattgaacacactgaacacacagtcattagcggtcttgaggagtggagctccgtagaaaagccattaaagctgttaaccgagattaaggaattgacattcaagataatctggaacatctttatgggcagtacgtcaattgactacaccacaaaggaaatggaagccctgtacgacgatgtggctttgggtctattctgttttccaattaactttccaggtttcaattttcataagagccttaaggctaggaaaagattgtacgagatcctgctgtcaattgttaacgagaagagactaatgaagaaatccaaaggtgagagctgggaagctaaagacatgatggatttaatgactgaggttgaggatgaggacggcgaaggcatggataacgaaacaatcacagacttgatattcgggaagttgttcgctggccacgagacgtccgccttcacaactatgtgggcaatcatatttctgaccgaccatccccacatcttccagagggccaaagaagaacaggaagacattataagaaggagaccaagcactcaaaagggtattaacctggtcgagttcaaacagatgaaattcctgtcccaagtgatagatgaaaccctaaggctatccagcattgcttttgccactttcagagaggccacgacagatataaatatcaatggtaaattaataccgaagggttggaaggtcatcttgtggcacaggggtttatacatggacgaagaattacatccttcccctcaagacttcaacccatcgaggtgggatgatttcatcggcaaccctggtgcattcaccccgtttgggttgggcgttagactttgcccaggcagggacttggccaagttggaaatcagcatcttcttacaccacttccttcttaactataagattgaaaggtataatccacagtgccaactaacctacctgccactgccacatcctaaggataaatgcctagctcgtgttttaaaagcagcaggtcaatgtgtttga

SEQ ID NO: 1035 - protein, 493 aa, Cucurbita pepo
MEIINGVFLILPLGFVLVFEVLKRLNGLYYAVKLGKKWGELPPGDLSWPLLGSTLSFLKSFTVGPPESFIRIFTTRYGKVDMYKTHMFGRASILVCKPEICRQVLIDETKFVPSYPACMKRLFGRKSLIRVSKAEHRKLRRMTMAPISSHAALEIYIEHTEHTVISGLEEWSSVEKPLKLLTEIKELTFKIIWNIFMGSTSIDYTTKEMEALYDDVALGLFCFPINFPGFNFHKSLKARKRLYEILLSIVNEKRLMKKSKGESWEAKDMMDLMTEVEDEDGEGMDNETITDLIFGKLFAGHETSAFTTMWAIIFLTDHPHIFQRAKEEQEDIIRRRPSTQKGINLVEFKQMKFLSQVIDETLRLSSIAFATFREATTDININGKLIPKGWKVILWHRGLYMDEELHPSPQDFNPSRWDDFIGNPGAFTPFGLGVRLCPGRDLAKLEISIFLHHFLLNYKIERYNPQCQLTYLPLPHPKDKCLARVLKAAGQCV

SEQ ID NO: 1036 - DNA, 1389 bp, Lagenaria siceraria
atggagttgattattaataactggcttctaattctaagctgcgttgggttcgcgttgggcctaggtgttttgaagaggttgaataacctgtattacgccataaagctaggcaagaagtgggatgaagtcccaccgggtgacttgagctggcctttattgggctcaacactgtccttcattaagtattttacgctaggcccaccgcacaattttatagcccaattctctaaccgttatggcaaggttgatatgtataagacacacatcttcggaagagcatctattattgtatgtaagcccgaaatttgcaggcaggtgttgacggacgaaacgaagttcgctccaggttacccaacgacaatgacatcattgttcggccgtagatccttgcatcgtgtctcaaaagtggagcacagaaagctaagaagattaaccacgactccaataagttcccacgcagcgttggagttgtatatcgatcatatagagcacacggtaataaatggcttggaagagtggtcatctatggaaaagcctttggaattgttgactgtgataaaggagttgacgttcaaaatcatatggaatatcttcatgggctcgaccccgatggggtcaatcgccatcagagagatggaagctctttacaacgacatttcgctaggtttcttctgccttcccattaacttccccggtttctacttccacaagtccttgaaggccaggaagagacttcacgaaatcctgcagtgcattgtgaacgagaagaggttagtgaagaagtccaagggagagacctgggaagctaaagatatgatggaccttatgatcgaagtaagagacgaggatggcgagggcatggacgatgagactatcgttgacctaatattcggaaagttattcgccgggcaggaaacgtccgcttttaccactatgtgggcaattctatttctgacaaacaatccacacgtgttccagaaggccaaggtaatcgatgagacgcttcgtgttagttctattaccttcgcaactttccgtgaggcaatgactgacgtaaagattaacggtaaaatcataccaaagggttggaaagtgatcttatggctaagggaattgaacatggatgagaagttgcacacctctccacaggaattcaacccttctagatgggataacttcatagggaaccccggggcatttaccccatttgggttaggcgttagaatgtgccccgggagagatttggcaaagctagagatttccatattccttcactacttcttgttgaactacaaggtggaacagctgaatcctcaatgccaactagattatctaccgattccccaccctaaggataagtgcctagctagggttctaaaggttgcttga

SEQ ID NO: 1037 - protein, 462 aa, Lagenaria siceraria
MELIINNWLLILSCVGFALGLGVLKRLNNLYYAIKLGKKWDEVPPGDLSWPLLGSTLSFIKYFTLGPPHNFIAQFSNRYGKVDMYKTHIFGRASIIVCKPEICRQVLTDETKFAPGYPTTMTSLFGRRSLHRVSKVEHRKLRRLTTTPISSHAALELYIDHIEHTVINGLEEWSSMEKPLELLTVIKELTFKIIWNIFMGSTPMGSIAIREMEALYNDISLGFFCLPINFPGFYFHKSLKARKRLHEILQCIVNEKRLVKKSKGETWEAKDMMDLMIEVRDEDGEGMDDETIVDLIFGKLFAGQETSAFTTMWAILFLTNNPHVFQKAKVIDETLRVSSITFATFREAMTDVKINGKIIPKGWKVILWLRELNMDEKLHTSPQEFNPSRWDNFIGNPGAFTPFGLGVRMCPGRDLAKLEISIFLHYFLLNYKVEQLNPQCQLDYLPIPHPKDKCLARVLKVA

SEQ ID NO: 1038 - DNA, 1386 bp, Siraitia grosvenorii
atgctgagcttcctaggctttgcggctttcttcttctgtttcttcctaattcactcactatttaaacttttctctgctgctagaagaaagctgcccctgccgccaggtagtatgggttggccctatatgggcgaaacccttcagttatattcacaggacccaaacgtgttctttgcgagtaagaagaaaagatacggaccaatcttcaaaagccacatcttgggatatccttgcgtcatgctaagttctcccgaggcagtcaaattcgtgttagttaccaaagcccacctatttaaaccaacgttccctgcatctaaagagcgtatgcttgggaagaacgctatcttcttccatcagggagactaccacgctaagttgcgtagacttgttttgaggaccttcatgcccgaagccatacgtattatggtaccatcgatagaaagtatcgctaagaatacagttcaatcgtgggaaggtcagctgatcaacaccttccaagagatgaaaatgtttgcattcgaagtttctctgctttcgatcttcggcaaagacgaagcactttatttcgaagacctgaagaggtgctattacatcctggaaaagggctacaattcgatgccaataaatttgccaggaacattgttccataaggcgatgaaggcaagaaaagagttagctcatattcttaacaagatcctatctacaagacgtgagatgaaaccggaccacaacgacttgctggggagttttatggggcagaaggaaggtcttactgatgaacagatcgctgacaatgtaattgggttgatattcgccgctagagatactaccgctagtgtcctgacctggatactaaagtacttgggtgaaaacccatcagttttacaagcagtgacagccgaacaggaagccattatgaagcagaagaggtcggctcacgacaacctgacttggggcgatactaagaacatgccaatcacttcaagagtgatacaagagaccctgagagtggcaagtgtgttgtccttcacattcagagaagctgttgaggatgtcgagtttgatggttatttaatcccaaagggatggaaagtattgcctcttttccgtaatattcatcattcaccagagattttcccccaacccgacaagttcgacccgagcagattcgaagtcgcccaaaagcccaacacgtacatgcctttcggttctggtacacactcatgtcccggtaatgagttggctaaacttgaaatgcttgtgctattgcatcacttgacgacaaagtacagatggtcggtagttggtgcgcaagagggtattcagtacggtccctttgctctacctcataatgggttacccattaggatctcattgaagaaatga

SEQ ID NO: 1039 - protein, 461 aa, Siraitia grosvenorii
MLSFLGFAAFFFCFFLIHSLFKLFSAARRKLPLPPGSMGWPYMGETLQLYSQDPNVFFASKKKRYGPIFKSHILGYPCVMLSSPEAVKFVLVTKAHLFKPTFPASKERMLGKNAIFFHQGDYHAKLRRLVLRTFMPEAIRIMVPSIESIAKNTVQSWEGQLINTFQEMKMFAFEVSLLSIFGKDEALYFEDLKRCYYILEKGYNSMPINLPGTLFHKAMKARKELAHILNKILSTRREMKPDHNDLLGSFMGQKEGLTDEQIADNVIGLIFAARDTTASVLTWILKYLGENPSVLQAVTAEQEAIMKQKRSAHDNLTWGDTKNMPITSRVIQETLRVASVLSFTFREAVEDVEFDGYLIPKGWKVLPLFRNIHHSPEIFPQPDKFDPSRFEVAQKPNTYMPFGSGTHSCPGNELAKLEMLVLLHHLTTKYRWSVVGAQEGIQYGPFALPHNGLPIRISLKK

SEQ ID NO: 1040 - DNA, 1485 bp, Siraitia grosvenorii
atggaagtggaacttaccaatttctgggtcatgattcttgccgcggtcttgggcttttgcgtatttgttttcggcttcctgagacgttttaatgacctttggaccatggtaaaactgggaaagaaggtttataaaactttaccgcctggagacatgggttggcctcttattggctcttcactttggttctacaaggccttttctgcatccggagacccagattcctttattaagcatttgcgttctagatatggtagagtcgggatgtataagacccatctgttcggtaaacccgcggtcattgtcactgatcccgagatatgccgtcgtgtatactctgacgacaagcacttcgtaatgtcttacccaaagtcggtaaagatattgggtactggaagtttgtctaggatagatcaccgtatcacacataggtttatggccgctcctatcaatggttccgaggctctggcgagatatgttggtttcatcgagcaggtagtagttaggggcctagaggaatggtcaagtatgaggaagcctatagagctgttgcatgaaatcaaaagattaactttcagaattataatccacgttttcatgggctcagcccttgatccacacattccaaaacttgagaagttgtacgctgaactgtctgctgccgtcttcgtggccttcgcaatcgacgtgccaggttccacctatcacagagctttgaaagctaaagaggagatccaaaacatcctaagacccgtaatcgaagagaagagacgtataatcgaaaagaacgaggaaatggaagataaatgtcagttggacgctgtaataaaaggtaagaacggcaaaggggaaaagatcttcgacaacgacgcaatcattgatatgctattggggttgctgtatgcaggtcatcacacctctgctcacggtaccatgtgggccttaattcaacttttggaacacccacaggtttatgaaaaggcgaaggaagaacaggaattaattatgaaacaacgtccatccacgcagaaggggttaatattcaacgaaatcaaacaaatgacctaccttgtaaaggtcattaatgagatgttgaggagagtgagtattgtgttcgccaacttcagagaggcggccacggacgttaacattaacggctataccatcccaaaaggttgggttgtgccggtgtggataaaaggcgttcatatggaccctcagatttacccgaatcctgaagaatttaacccttcgcgttgggatacccacacacccaagcctggcgcttttattcccttcggatttggtaatcgtttctgccccgggaacgaattagccaaactggaaattacaatcctactacaccatttcttattgaaatataggtgggagagagtgaaccccaaggcctctattacaagcgttccaatgccctcaccgattgaccagtgtttagccaagataactgccatcccatcctcatag

SEQ ID NO: 1041 - protein, 494 aa, Siraitia grosvenorii
MEVELTNFWVMILAAVLGFCVFVFGFLRRFNDLWTMVKLGKKVYKTLPPGDMGWPLIGSSLWFYKAFSASGDPDSFIKHLRSRYGRVGMYKTHLFGKPAVIVTDPEICRRVYSDDKHFVMSYPKSVKILGTGSLSRIDHRITHRFMAAPINGSEALARYVGFIEQVVVRGLEEWSSMRKPIELLHEIKRLTFRIIIHVFMGSALDPHIPKLEKLYAELSAAVFVAFAIDVPGSTYHRALKAKEEIQNILRPVIEEKRRIIEKNEEMEDKCQLDAVIKGKNGKGEKIFDNDAIIDMLLGLLYAGHHTSAHGTMWALIQLLEHPQVYEKAKEEQELIMKQRPSTQKGLIFNEIKQMTYLVKVINEMLRRVSIVFANFREAATDVNINGYTIPKGWVVPVWIKGVHMDPQIYPNPEEFNPSRWDTHTPKPGAFIPFGFGNRFCPGNELAKLEITILLHHFLLKYRWERVNPKASITSVPMPSPIDQCLAKITAIPSS

SEQ ID NO: 1042 - DNA, 1482 bp, Siraitia grosvenorii
atggctatattcttcttcttcttcttcttcctactggtcgtgtccgttgttttcgtgtttctattcttaagagcttcgcgtttccgtagagttaggttgccaccaggttccctagggttaccgctgattggcgagacgctacaattgatttcagcatataagacggaaaatccagaaccatttattgacgaaagggtgcgtagattcggcgccgttttcacgactcacttgtttggtgaacctacggttttcagcgctgattgggaaactaaccgttttattctacagaacgaggaaaagctgtttgaatgctcttacccaggctcaatcagtaacctgttgggcaaacattccctgctgcttatgaagggtaacttgcataagaggatgcattctttaactatgtcgttcgcaaactcctcaatcataagggatcatttgttactagatgttgacagattgataaggttgaacttggattcttggactggcagaattttcctgatggaagaggcgaagaagataacttttgagttagctgtgaaacagttgatgagctttgacaggtgcgaatggactcagaaccttatgaaagagtatttactggtcatagaggggttctttactgtacctttacctctgctatccactacctataggcgtgctataagggcgagaacaaaagtcgctgaagctctgggtttagtcgtcagacaaagacgtaaagagtcagacgcaggcaagaggaagaatgatatgttgggtgctctgcttgctgctgaagacgcattatcagacgaccaaatcgtggacttcttactggctctgttggtggcaggatacgaaaccactagtactacaatgactttggccgttaagttccttaccgaggccccattagcccttacccaattgcaagaggaacatgaacagattaaagctaggaagaaggaagcggaccagcacttgcaatggaatgactataaatctatgccttttacgcaatgcgtggtaaacgaaacactgagagtggctaatataatttcaggcgtgtttaggcgtgcgatgactgatataaacatcaagggttacactattcccaagggatggaaggtatttgcttctttcagggcagttcatcttgatcatgatcacttcaaagacgcgcgttcgtttaacccttggagatggcaacagaacacatctggtagtacagtgaatgccttcaccccctttggtggtggtcccaggctttgcccaggttacgaattagcccgtgtagagctgtcagtgttcttgcatcactttgtcactcagttctcctgggtgcccgccgaggacgacaagctagtcttcttcccaaccaccaggacgcaaaagagatatcccataaatgttatgcgtaagaacgaaaccagacaaagaaaagattcactggactcaaggcacatgaagggtcaagagtcttcttttgacatgtag

SEQ ID NO: 1043 - protein, 493 aa, Siraitia grosvenorii
MAIFFFFFFFLLVVSVVFVFLFLRASRFRRVRLPPGSLGLPLIGETLQLISAYKTENPEPFIDERVRRFGAVFTTHLFGEPTVFSADWETNRFILQNEEKLFECSYPGSISNLLGKHSLLLMKGNLHKRMHSLTMSFANSSIIRDHLLLDVDRLIRLNLDSWTGRIFLMEEAKKITFELAVKQLMSFDRCEWTQNLMKEYLLVIEGFFTVPLPLLSTTYRRAIRARTKVAEALGLVVRQRRKESDAGKRKNDMLGALLAAEDALSDDQIVDFLLALLVAGYETTSTTMTLAVKFLTEAPLALTQLQEEHEQIKARKKEADQHLQWNDYKSMPFTQCVVNETLRVANIISGVFRRAMTDINIKGYTIPKGWKVFASFRAVHLDHDHFKDARSFNPWRWQQNTSGSTVNAFTPFGGGPRLCPGYELARVELSVFLHHFVTQFSWVPAEDDKLVFFPTTRTQKRYPINVMRKNETRQRKDSLDSRHMKGQESSFDM

SEQ ID NO: 1044 - DNA, 1476 bp, Siraitia grosvenorii
atggatgaattaaagtggtttgtcctaattccagcaaccttcttcttagtcgttttcgttttcgaagttctgaagaggttgaacggttggtactacgctacaaaattatggaagatatgggatgagctgccgcccggggatatgggctggcccctgttagggtccaccctttcttacatcaatgactttacagctgggcaaccacagaatttcatcagaacctttagtaataggtatggcaaggctgatatgtacaaaactcacattttgggcagggcgtctataatcatctgtacaccagaaatttgcagacaggtcttgactaacgaggataagttcaaacccagtttgcctggcaacatgaaaattcttagcggaagaaaatcattgatgcaagttagcaaggcagaacaccgtagattaagaaggctaaccatggctcctatttccggacatgctgcattagaaatgtacatctcacatatacaggctacagtcgtcggcggactggaagagtgggcttccattcaaaggcctgttgagcttgtgaccgagatcaagcgtctgacattcaaagttatatggaatatctttatgggaagcacttccttagattcgtccatgggtgcgatggaagccctattttcggacgtcgctgtgggcttcctatcattgcctataaacttccccgggttttacttccataaatctttaaaggcgaggaaaagacttatagagatacttcagtctattatcaacgaaaagcgtctagttaagaagtcgaaaggcgagtcctgggaagcgaaggatatgatggacctgatgatcgaagtgaaagatgaggacggcgaggagctggacgatgagactatcattgatctaatatttggaaaattgttcgccggacacgagacttccgcgttcaccgctatgtgggctgtattgttcctaaccgatcatccgcagatatttcaaaaggcgaaggaagagcaagaagagataatcagacgtagacctagtactcagaagggtattaacttgtcagactacaagcagatgaagttcttatcgcaagtgatcgacgaaaccttaagagtctcctgcataacctcgctgttatttagagaggcgactgcagatgtcgaaatcaatggtaagataattcccaagggctggagagtgttgccatggttgggaatgctgtacatggacgaaaacttgtttccctcgccgcaggagttcaacccttctaggtgggacaactttgtccctaaaccaggtgctttcattccattcggtgtggggaacaggttctgtcctgggtcagacctagccaagctggagatatccatattcctgcattacttcttattaaactacaaggtcgaaagattgaaccctaaatgccatcttacgtgcttgccttttcctcaccctactgataagtgcttggctagggtacacaaggtggcttag

SEQ ID NO: 1045 - protein, 491 aa, Siraitia grosvenorii
MDELKWFVLIPATFFLVVFVFEVLKRLNGWYYATKLWKIWDELPPGDMGWPLLGSTLSYINDFTAGQPQNFIRTFSNRYGKADMYKTHILGRASIIICTPEICRQVLTNEDKFKPSLPGNMKILSGRKSLMQVSKAEHRRLRRLTMAPISGHAALEMYISHIQATVVGGLEEWASIQRPVELVTEIKRLTFKVIWNIFMGSTSLDSSMGAMEALFSDVAVGFLSLPINFPGFYFHKSLKARKRLIEILQSIINEKRLVKKSKGESWEAKDMMDLMIEVKDEDGEELDDETIIDLIFGKLFAGHETSAFTAMWAVLFLTDHPQIFQKAKEEQEEIIRRRPSTQKGINLSDYKQMKFLSQVIDETLRVSCITSLLFREATADVEINGKIIPKGWRVLPWLGMLYMDENLFPSPQEFNPSRWDNFVPKPGAFIPFGVGNRFCPGSDLAKLEISIFLHYFLLNYKVERLNPKCHLTCLPFPHPTDKCLARVHKVA

SEQ ID NO: 1046 - DNA, 1473 bp, Siraitia grosvenorii
atggaactttggctgtggttgttgggtgcttctgtaggcgcatacgttttcgtgttcggtatactgagaaaccttaatcagtggagatttgttaccagacataggaacagatacaacctgccacccggagatatgggctggccccttatcggaacattgctaccattccttcaagctttcagaagcggtcgtcccgacagctttatacattacttcgcgtccacatatggtaaaataggtatgtacaagacctacctgtttggttccccatctgtcatagtttgcctaccagaagtgtgcagacacgttttgatgaacgacgaacagttcgtgttcgggtacagtaaagcaactagaatccttacaggatcaaaggctttaaacacagtaccgaaggctgaacatagaaggttaagaagattgatagcctcgttgatatccgggaacgacgctttgtcagtatacatcggacacgttgagggtatcgttattaactgtttacaggagtggggatctatgaagaagcctgtcgagttcctgtccgagatgaaaaccgttgcttttaaagtgcttcttcacatctttattggctctacgagcgcagcctttatcgacaagatggagaagctttatacggactttcacttaggtttcatgtccacaccaatcgatttgccaggcactacgttctcacgtgctttgaaggcgagaaatgagcttattagaatcttcgaaaacgtgctaaaggagaagagggccaatttgaagtcgaaggaaggcgaaaatcgtaagaaggatatgactgacttgttgttggaagtacgtgatgaggatggccaaggccttgatgatggttgtattattgacctacttataggtttcttcttcgcgggacatgagacgtcggctcattcaatcatgcgtgcaataatgttcctaagcgagaatccagaaacattgttaaaagctaaagctgaacaggagcaaatcgtaaaggctagacctgcagacgaccaacacaaagggttgacaatgaaagagataaagcaaatggagtacctgagtaaggtgattgacgaaacattacgtaaaaccagcttagcttttactctaagtagggaaacaaaggttgacgtgaatctaaacggatacacgatcccaaagggctggaagatactggtttggacaagggccgtccacatggatccagaaatatacgaaagtcctcagaaattcgatccatccagatgggataattccaaaagaagggccggtagcttcattccgttcggggctggaatgagactatgcccaggtatagatctatccaaactggaaatagcaattttcttgcactactttatttatggtggctttaggctggagagggtcaatcctaactgccctgagaactatcttccgctggccaggcctacggataactgcctggcccgtgtcgtcagggactcatag

SEQ ID NO: 1047 - protein, 490 aa, Siraitia grosvenorii
MELWLWLLGASVGAYVFVFGILRNLNQWRFVTRHRNRYNLPPGDMGWPLIGTLLPFLQAFRSGRPDSFIHYFASTYGKIGMYKTYLFGSPSVIVCLPEVCRHVLMNDEQFVFGYSKATRILTGSKALNTVPKAEHRRLRRLIASLISGNDALSVYIGHVEGIVINCLQEWGSMKKPVEFLSEMKTVAFKVLLHIFIGSTSAAFIDKMEKLYTDFHLGFMSTPIDLPGTTFSRALKARNELIRIFENVLKEKRANLKSKEGENRKKDMTDLLLEVRDEDGQGLDDGCIIDLLIGFFFAGHETSAHSIMRAIMFLSENPETLLKAKAEQEQIVKARPADDQHKGLTMKEIKQMEYLSKVIDETLRKTSLAFTLSRETKVDVNLNGYTIPKGWKILVWTRAVHMDPEIYESPQKFDPSRWDNSKRRAGSFIPFGAGMRLCPGIDLSKLEIAIFLHYFIYGGFRLERVNPNCPENYLPLARPTDNCLARVVRDS

SEQ ID NO: 1048 - DNA, 1410 bp, Siraitia grosvenorii
atgtggctgttgttgatcggtgctatcgttgttttgtctttcactagatggttgtacggttggaagaatccaaagtgtaatggtaaattgccaccaggttctatgggttttccattattgggtgaaaccttgcaattcttctctccaaacacttcttctgatgttccaccattcatcagaaaaagaatggatagatacggtccaatcttcaggactaatttggttggtagaccattgatcgtttccaccgattctgatttgaactacttcatcttccaacaagagggtcagttgttccaatcttggtatccagatactttcaccgaaatcttcggtagacaaaacgttggttcattgcacggttttatgtacaagtacctgaagaacatggtcttgcatttgtttggtccagaatccttgagaaagatgatcccagaagttgaagctgctgctactagaagattgagacaatggtcatctcataacaccgttgaattgaaagacgaaaccgcctctatgatttttgatttgaccgccaaaaagctgatctcctacgatttggaatcttcctcagaaaacttgagagataacttcgttgccttcatccagggtttgatttcttttccattgaacgttccaggtactgcttatcataagtgcttgcaaggtagaaaaagggccatgagaatgctgaagaatatgttgcaagaaagaagggctaacccaagaaagcaacaaattgacttcttcgacttcgtcttggaagagttggaaaaagatggtactttgttgaccgaagaaatcgccttggatttgatgttcgttttgttgttcgcttctttcgaaaccacttctttggctttgactgctgccattaagtttttgttggataacccacacgttttggaggaattgacagctgaacatgaaggtatcttgaagagaagagaaaacgctgattctggtttgacttggggtgagtacaaatctatgactttcaccttccagttcatcaacgaaactgttagattggctaatatcgtcccaggtattttcagaaaggctttgagagacatccaattcaagggttatacaattccagctggttgggctgttatggtttgtccaccagctgttcatttgaatccagaaaagtacattgatcccttggcttttaatccttggagatgggaaaagtctgaattgaacggtgcttccaaacattttatggcttttggtggtggtatgagattctgtgttggtactgatttcaccaaggttcaaatggctgttttcttgcattgcttggttaccaagtacagattcaaggctatcaaaggtggtaacattattagaactccaggcttgcaatttccaaacggtttccatattcaaatcaccgagaagtaa

SEQ ID NO: 1049 - protein, 469 aa, Siraitia grosvenorii
MWLLLIGAIVVLSFTRWLYGWKNPKCNGKLPPGSMGFPLLGETLQFFSPNTSSDVPPFIRKRMDRYGPIFRTNLVGRPLIVSTDSDLNYFIFQQEGQLFQSWYPDTFTEIFGRQNVGSLHGFMYKYLKNMVLHLFGPESLRKMIPEVEAAATRRLRQWSSHNTVELKDETASMIFDLTAKKLISYDLESSSENLRDNFVAFIQGLISFPLNVPGTAYHKCLQGRKRAMRMLKNMLQERRANPRKQQIDFFDFVLEELEKDGTLLTEEIALDLMFVLLFASFETTSLALTAAIKFLLDNPHVLEELTAEHEGILKRRENADSGLTWGEYKSMTFTFQFINETVRLANIVPGIFRKALRDIQFKGYTIPAGWAVMVCPPAVHLNPEKYIDPLAFNPWRWEKSELNGASKHFMAFGGGMRFCVGTDFTKVQMAVFLHCLVTKYRFKAIKGGNIIRTPGLQFPNGFHIQITEK

SEQ ID NO: 1050 - DNA, 1191 bp, Bacillus licheniformis
atgagacataaacatatcgcgatttttaatattccggctcacggccatattaatccaacgctagctttaacggcaagccttgtcaaacgcggttatcgggtaacatatccggtgacggatgagtttgtgaaggctgttgaggaaactggggcagagccgctcaactaccgctcaactttaaatatcgatccgcagcaaattcgggagctgatgaaaaataaaaaagatatgtcgcaggctccgctgatgtttatcaaagaaatggaggaggttcttcctcagcttgaagcgctctatgagaatgacaagccagaccttatcctttttgactttatggccatggcgggaaaactgctggctgagaagtttggaatagaggcggtccgcctttgttctacatatgcacagaacgaacattttacattcagatccatttctgaagagtttaagatcgagctgacgcctgagcaagaggatgctttgaaaaattcgaatcttccgtcatttaactttgaggatatgttcgagcctgcaaaattgaacattgtctttatgcctcgtgcttttcagccttacggcgaaacgtttgatgagcggttctcttttgttggtccttctcttgccaaacgcaagtttcaggaaaaagaaacgccgattatttcggacagcggccgtcctgtcatgctgatatctttagggacggcgttcaatgcctggccggaattttatcatatgtgcatagaagcattcagggacacgaagtggcaggttatcatggctgttggcacgacaatcgatcctgaaagctttgatgacatacctgagaacttttcgattcatcagcgcgttcctcagctggagatcctgaagaaagcggagctgttcatcacccatgggggtatgaacagtacgatggaagggttgaatgccggtgtaccgctcgttgccgttccgcaaatgcctgaacaggaaatcactgcccgccgcgtcgaagagcttgggcttggcaagcatttgcagccggaagacacaacagcagcttcactgcgggaagccgtctctcagacggatggtgacccgcatgtcctgaaacggatacaggacatgcaaaagcacattaaacaagccggaggggccgagaaagccgcagatgaaattgaggcatttttagcacccgcaggagtaaaataa

SEQ ID NO: 1051 - protein, 396 aa, Bacillus licheniformis
MRHKHIAIFNIPAHGHINPTLALTASLVKRGYRVTYPVTDEFVKAVEETGAEPLNYRSTLNIDPQQIRELMKNKKDMSQAPLMFIKEMEEVLPQLEALYENDKPDLILFDFMAMAGKLLAEKFGIEAVRLCSTYAQNEHFTFRSISEEFKIELTPEQEDALKNSNLPSFNFEDMFEPAKLNIVFMPRAFQPYGETFDERFSFVGPSLAKRKFQEKETPIISDSGRPVMLISLGTAFNAWPEFYHMCIEAFRDTKWQVIMAVGTTIDPESFDDIPENFSIHQRVPQLEILKKAELFITHGGMNSTMEGLNAGVPLVAVPQMPEQEITARRVEELGLGKHLQPEDTTAASLREAVSQTDGDPHVLKRIQDMQKHIKQAGGAEKAADEIEAFLAPAGVK

SEQ ID NO: 1052 - DNA, 1365 bp, Siraitia grosvenorii
atggagaaaggcgatacgcatattctagtgtttcctttcccttcacaaggccacataaaccctcttcttcaactatcgaagcgcctaatcgccaagggaatcaaggtttcgctggtcacaaccttacatgttagcaatcacttgcagttgcagggtgcttattccaactccgtgaagatcgaagtcatttccgatggctctgaggatcgtctggaaaccgatactatgcgccaaactctggatcgatttcggcagaagatgacgaagaacttggaagatttcttgcagaaagccatggtttcttcaaatccgcctaaattcattctgtatgattcgacaatgccgtgggttttggaggtcgccaaggagttcggactcgatagggccccgttctacactcagtcttgtgcgcttaacagtatcaattatcatgttcttcatggtcaattgaagcttcctcctgaaacccccacgatttcgttgccttctatgcctctgcttcgccccagcgatctcccggcttatgattttgatcctgcctccactgacaccatcatcgatcttcttaccagtcagtattctaatatccaggatgcaaatctgcttttctgcaacacttttgacaagttggaaggcgagattatccaatggatggagaccctgggtcgccctgtgaaaaccgtaggaccaactgttccatcagcctacttagacaaaagggtagagaacgacaagcactatgggctgagtctgttcaagcccaacgaggacgtctgcctcaaatggcttgatagcaagccctctggttctgttctgtatgtgtcttatggcagtttggttgaaatgggggaagagcagctgaaggagttggctctgggaatcaaggaaactggcaagttcttcttgtgggtggtgagagacactgaagcagagaagcttcctcccaactttgtggagagtgtggcagagaaggggcttgtggtcagctggtgctcccagctggaggtattggctcacccctccgtcggctgcttcttcacgcactgtggctggaactcgacgcttgaggcgctgtgcttgggcgtcccggtggtcgctttcccacagtgggctgatcaggtaaccaatgcaaagtttttggaagatgtttggaaggttgggaagagggtgaagcggaatgagcagaggctggcaagtaaagaagaagtaaggagttgcatttgggaagtgatggagggagagagagccagcgagttcaagagcaactccatggagtggaagaagtgggcaaaagaagctgtggatgaaggtgggagctctgataagaacattgaggagtttgtggccatgctcaagcaaacttga

SEQ ID NO: 1053 - protein, 454 aa, Siraitia grosvenorii
MEKGDTHILVFPFPSQGHINPLLQLSKRLIAKGIKVSLVTTLHVSNHLQLQGAYSNSVKIEVISDGSEDRLETDTMRQTLDRFRQKMTKNLEDFLQKAMVSSNPPKFILYDSTMPWVLEVAKEFGLDRAPFYTQSCALNSINYHVLHGQLKLPPETPTISLPSMPLLRPSDLPAYDFDPASTDTIIDLLTSQYSNIQDANLLFCNTFDKLEGEIIQWMETLGRPVKTVGPTVPSAYLDKRVENDKHYGLSLFKPNEDVCLKWLDSKPSGSVLYVSYGSLVEMGEEQLKELALGIKETGKFFLWVVRDTEAEKLPPNFVESVAEKGLVVSWCSQLEVLAHPSVGCFFTHCGWNSTLEALCLGVPVVAFPQWADQVTNAKFLEDVWKVGKRVKRNEQRLASKEEVRSCIWEVMEGERASEFKSNSMEWKKWAKEAVDEGGSSDKNIEEFVAMLKQT

SEQ ID NO: 1054 - DNA, 1488 bp, Barbarea vulgaris
atggtttccgaaatcacccataaatcttatcctcttcactttgttctcttccctttcatggctcaaggccacatgattcccatggttgatattgcaaggctcttggctcagcgcggtgtgaaaataacaattgtcacaacgccgcacaatgcagcgaggttcgagaatgtcctaagccgtgccattgagtctggcttgcccatcagcatagtgcaagtcaagcttccatctcaagaagctggcttaccagaaggaaatgagactttcgattcacttgtctcgatggagttgctggtacctttctttaaagcggttaacatgcttgaagaaccggtccagaagctctttgaagagatgagccctcaaccaagctgtataatttctgatttttgtttgccttatacaagcaaaatagccaagaagttcaatatcccaaagatcctcttccatggcatgtgttgcttttgtcttctgtgtatgcatgttttacgcaaaaaccgtgagatcttggaaaacttaaagtctgacaaggagcatttcgttgttccttattttcctgatcgagttgaattcacaagacctcaagttccaatggcaacatatgttcctggagagtggcacgagatcaaggaggatatagtagaagcggataagacttcctatggtgtgatagtcaacacatatcaagagctcgagcctgcttatgccaacgactacaaggaggcaaggtctggtaaagcatggaccattggacctgtttccttgtgcaacaaggtgggagccgacaaagcagagaggggaaacaaagcagacattgatcaagatgagtgtcttaaatggcttgattctaaagaagaaggttcggttctatatgtttgccttggaagtatctgcagtcttcctctgtctcagctcaaagagctggggctaggccttgaggaatcccaaagacctttcatttgggtcgtaagaggttgggagaagaacaaagagttacttgagtggttctcggagagcggatttgaagaaagagtaaaagacagagggcttctcatcaaaggatggtcacctcaaatgcttatccttgcacatcattccgttggagggttcttaacacactgtggatggaactcgaccctcgaaggaatcacttcaggcattccattgctcacttggccactgtttggagaccaattctgcaaccaaaaacttgtcgtgcaggtgctaaaagtgggtgtaagtgccggggttgaagaggttacgaattggggagaagaggagaaaataggagtattagtggataaagagggagtgaagaaggcagttgaagaattaatgggtgagagtgatgatgctaaagaaagaagaaaaagagtcaaagagcttggacaattagctcaaaaggctgtggaggaaggaggctcatctcattctaatatcacatccttgctagaagacataatgcaactagcacaatctaataattga

SEQ ID NO: 1055 - protein, 495 aa, Barbarea vulgaris
MVSEITHKSYPLHFVLFPFMAQGHMIPMVDIARLLAQRGVKITIVTTPHNAARFENVLSRAIESGLPISIVQVKLPSQEAGLPEGNETFDSLVSMELLVPFFKAVNMLEEPVQKLFEEMSPQPSCIISDFCLPYTSKIAKKFNIPKILFHGMCCFCLLCMHVLRKNREILENLKSDKEHFVVPYFPDRVEFTRPQVPMATYVPGEWHEIKEDIVEADKTSYGVIVNTYQELEPAYANDYKEARSGKAWTIGPVSLCNKVGADKAERGNKADIDQDECLKWLDSKEEGSVLYVCLGSICSLPLSQLKELGLGLEESQRPFIWVVRGWEKNKELLEWFSESGFEERVKDRGLLIKGWSPQMLILAHHSVGGFLTHCGWNSTLEGITSGIPLLTWPLFGDQFCNQKLVVQVLKVGVSAGVEEVTNWGEEEKIGVLVDKEGVKKAVEELMGESDDAKERRKRVKELGQLAQKAVEEGGSSHSNITSLLEDIMQLAQSNN

SEQ ID NO: 1056 - DNA, 1488 bp, Barbarea vulgaris
atggtttccgaaatcacccataaatcttatcctcttcactttgttctcttccctttcatggctcaaggccacatgattcccatggttgatattgcaaggctcttggctcagcgcggtgtgaaaataacaattgtcacaacgccgcacaatgcagcgaggttcgagaatgtcctaagccgtgccattgagtctggcttgcccatcagcatagtgcaagtcaagcttccatctcaagaagctggcttaccagaaggaaatgagactttcgattcacttgtctcaacaaagttgctggtacctttctttaaagcggttaacatgcttgaagaaccggtccagaagctctttgaagagatgagccctcaaccaagctgtataatttctgatttttgtttgccttatacaagcaaaatcgccaagaagttcaatatcccaaagatcctcttccatggcatgtgttgcttttgtcttctgtgtatgcatgttttacgcaagaaccgtgagatcttggaaaacttaaagtctgacaaggagcatttcgttgttccttattttcctgatcgagttgaattcacaagacctcaagttccattggcaacatatgttcctggggaatggcacgagatcaaggaggatatggtagaagcggataagacttcctatggtgtgatagtcaacacatatcaagagctcgagcctgcttatgccaacggctacaaggaggcaaggtctggtaaagcatggaccattggacctgtttccttgtgcaacaaggtgggagccgacaaagcagagaggggaaacaaagcagacattgatcaagatgagtgtcttaaatggcttgattctaaagaagaaggttcggttctatatgtttgccttggaagtatctgcagtcttcctctgtctcagctcaaggagctggggctaggccttgaggaatcccaaagacctttcatttgggtcgtaagaggttgggagaagaacaaagagttacttgagtggttctcggagagcggatttgaagaaagagtaaaagacagagggcttctcatcaaaggatggtcacctcaaatgcttatccttgcacatcattccgttggagggttcttaacacactgtggatggaactcgaccctcgaaggaatcacttcaggcgttccattgctcacttggccactgtttggagaccaattctgcaaccaaaaacttgtcgtgcaggtgctaaaagtgggtgtaagtgccggggttgaagaggttacgaattggggagaagaggagaaaataggagtattagtggataaagagggagtgaagaaggcagtggaagaattaatgggtgagagtgatgatgctaaagaaataagaaaaagagtcaaagagcttggacaattagctcacaaggctgtggaggaaggaggctcatctcattctaatatcacatccttgctagaagacataatgcaactagcacaacctaataattga

SEQ ID NO: 1057 - protein, 495 aa, Barbarea vulgaris
MVSEITHKSYPLHFVLFPFMAQGHMIPMVDIARLLAQRGVKITIVTTPHNAARFENVLSRAIESGLPISIVQVKLPSQEAGLPEGNETFDSLVSTKLLVPFFKAVNMLEEPVQKLFEEMSPQPSCIISDFCLPYTSKIAKKFNIPKILFHGMCCFCLLCMHVLRKNREILENLKSDKEHFVVPYFPDRVEFTRPQVPLATYVPGEWHEIKEDMVEADKTSYGVIVNTYQELEPAYANGYKEARSGKAWTIGPVSLCNKVGADKAERGNKADIDQDECLKWLDSKEEGSVLYVCLGSICSLPLSQLKELGLGLEESQRPFIWVVRGWEKNKELLEWFSESGFEERVKDRGLLIKGWSPQMLILAHHSVGGFLTHCGWNSTLEGITSGVPLLTWPLFGDQFCNQKLVVQVLKVGVSAGVEEVTNWGEEEKIGVLVDKEGVKKAVEELMGESDDAKEIRKRVKELGQLAHKAVEEGGSSHSNITSLLEDIMQLAQPNN

SEQ ID NO: 1058 - DNA, 1485 bp, Barbarea vulgaris
atggcttctgaaactacacatcaattccattcaccattacatttcgttttgttcccttttatggcacaaggtcatatgatcccaatggttgatatcgctagaatcttggcacaaagaggtgttactatcacaatcgttactacaccacataacgctgcaagattcaaaaacgttttgtctagagctatccaatcaggtttgccaattaatttggttcaagcaaagttcccatctcaagaatctggttcattggaaggtcatgaaaatttggatttgttggattctttaggtgcttcattgactttctttaaggcaacaaacatgttcgaaaagccagttgaaaagttgttaaaagaaattcaaccaagaccatcatgtattattggtgacatgtgtttgccatacactaacagaattgctaaaaatttgggtattccaaaaattatttttcatggcatgtgttgttttaatttgttatgtatgcatattatgagacaaaactacgaattcttggaaacaatcgattctgaaaaggaatacttcccaatcccaaacttcccagaaagagctgaattcactaagtcacaattgccaatgatcacatacgctggtgaattcaaagaattcttggatgaagttactgaaggtgacaacacatcttacggtgttattgttaacactttcgaagaattagaaccagcttacgttagagattacaagaaagttaaggctggtaaagtttggtctattggtccagtttcattgtgtaataaggttggtgaagataaagctgaaagaggtaataaggctgcaatcgatcaagatgaatgtatcaagtggttggattctaaggaagaaggttcagttttgtacgtttgtttgggttctatctgtaatttgccattgtcacaattgaaagaattgggtttaggtttggaagaatctcaaagaccttttatttgggttattagaggttgggaaaagtacaacgaattagctgaatggatctctgaatcaggttttaaagaaagaattaaagaaagaggtttgttaattagaggttggtctccacaaatgttaattttgtcacatccagcagttggtggtttcttgactcattgtggttggaattctactttggaaggtattacatcaggtgttccattgttaacatggccattatttggtgaccaattctgtaacgaaaagttggttgttcaagttttgaaagttggtgttagatctggtgttgaagaatcaatgaaatggggtcaagaagaaaacatcggtgttttggttgataaagaaggtgttaagaaagctgttgaagaagttatgggtgaatctgatgatgcaaaggaaagaagaagaagagttaaggaattaggtcaattggctcataaagcagttgaagaaggtggttcttcacattctaacatcacatcattgttgcaagatattagacaattgcaatctaagaaataa

SEQ ID NO: 1059 - protein, 494 aa, Barbarea vulgaris
MASETTHQFHSPLHFVLFPFMAQGHMIPMVDIARILAQRGVTITIVTTPHNAARFKNVLSRAIQSGLPINLVQAKFPSQESGSLEGHENLDLLDSLGASLTFFKATNMFEKPVEKLLKEIQPRPSCIIGDMCLPYTNRIAKNLGIPKIIFHGMCCFNLLCMHIMRQNYEFLETIDSEKEYFPIPNFPERAEFTKSQLPMITYAGEFKEFLDEVTEGDNTSYGVIVNTFEELEPAYVRDYKKVKAGKVWSIGPVSLCNKVGEDKAERGNKAAIDQDECIKWLDSKEEGSVLYVCLGSICNLPLSQLKELGLGLEESQRPFIWVIRGWEKYNELAEWISESGFKERIKERGLLIRGWSPQMLILSHPAVGGFLTHCGWNSTLEGITSGVPLLTWPLFGDQFCNEKLVVQVLKVGVRSGVEESMKWGQEENIGVLVDKEGVKKAVEEVMGESDDAKERRRRVKELGQLAHKAVEEGGSSHSNITSLLQDIRQLQSKK

SEQ ID NO: 1060 - DNA, 1494 bp, Barbarea vulgaris
atggcatctgaatcatgtcatcattctcattgtccattgcatttcgttttgttcccttttatggctcaaggtcatatgattccaatggttgatattgctagattgttagcattgagaggtgctactatcacaatcgttactacaccacataacgcaactagattcaataatttgttgtcaagagctattgaatctgatttgtcaattaatatcgttcatgttaacttcccataccaagaagcaggtttgtctgaaggtcaagaaaacgttgatttgttggaatcaatgggtttgatggttccatttttaaaggctgttaacatgttggaagaaccagttatgaagttgatggaagaaatgaagccaagaccatcttgtttgatttcagatttttgtttacattacacttctaagatcactaaaaagtttaatatcccaaagatcgttttccatggtatgggttgtttctgtttgttgtgtatgcacgttttgagaagaaacatcgaaatcttgaaaaatttgaagtctgataaggaatactttttggttccatcattcccagatatcgttgaattcactaaaccacaagttccagttgaaacaaatgcatctggtgactggaaagaatttttggaagcaatggttgaagctgaagatacttcatacggtgttattgttaacacattccaagaattagaaccagcttacgttaaggattacaaagaagctagagctggtaaagtttggtctattggtccagtttcattgtgtaataagatcgaagctgataaagcagaaagaggtaataaggctgcaatcgatcaagaagaatgtttgaagtggttggattctaaagaagaaggttcagttttgtacgtttgtttgggttctatctgtaatttgccattggctcaattgaaggaattaggtatcggtttggaagaatcacaaagaccttttatttgggttattagaggttgggaaaagtacaacgaattgtctgaatggatgttggaatcaggtttcgaagaaagagttaaggatagaggtttgttgattaaaggttggtctccacaaatgttggttttatctcatccatcagttggtggtttcttgactcattgtggttggaattctactttagaaggtattacatcaggtgttccattgttaacatggccattgtttgcagatcaattttgtaacgaaaagttggttgttcaagttttgaaagttggtgttagagctggtgttgaagatccaatgtcttggggtgaagaagaaaaagttggtgttttgttggataaggaaggtgttaagaaagcagttgaagaattaatgggtgaatcagatgatgctaaggaaagaagaaagagagttaaggaattgggtgaattagctcataaagcagttgaagaaggtggttcttcacattctaatattactttgtttttacaagatatttctcaatataaatcagttggtacattttaa

SEQ ID NO: 1061 - protein, 497 aa, Barbarea vulgaris
MASESCHHSHCPLHFVLFPFMAQGHMIPMVDIARLLALRGATITIVTTPHNATRFNNLLSRAIESDLSINIVHVNFPYQEAGLSEGQENVDLLESMGLMVPFLKAVNMLEEPVMKLMEEMKPRPSCLISDFCLHYTSKITKKFNIPKIVFHGMGCFCLLCMHVLRRNIEILKNLKSDKEYFLVPSFPDIVEFTKPQVPVETNASGDWKEFLEAMVEAEDTSYGVIVNTFQELEPAYVKDYKEARAGKVWSIGPVSLCNKIEADKAERGNKAAIDQEECLKWLDSKEEGSVLYVCLGSICNLPLAQLKELGIGLEESQRPFIWVIRGWEKYNELSEWMLESGFEERVKDRGLLIKGWSPQMLVLSHPSVGGFLTHCGWNSTLEGITSGVPLLTWPLFADQFCNEKLVVQVLKVGVRAGVEDPMSWGEEEKVGVLLDKEGVKKAVEELMGESDDAKERRKRVKELGELAHKAVEEGGSSHSNITLFLQDISQYKSVGTF

SEQ ID NO: 1062 - DNA, 1488 bp, Barbarea vulgaris
atggcatcaatcactaaccataagtctgatccattgcatttcgttttgttcccttttatggctcaaggtcatatgattccaatggttgatattgctagattgttagcacaaagaggtttgactatcacaatcgttactacaccacataacgcatcaagattcaaaaacgttttgaatagagctattgaatctggtttgccaattaatatcttgcatgttaagttgccatatcaagaagtcggtttacctgaaggtttggaaaacatcgattgtttcgattcaatggaacatatgatcccatttttcaagggtgttaacatggttgaagaatctgttcaaaagttgttcgaagaaatgtctccaagaccatcatgtatcatctctgatttctgtttgccatacacatcaaaggttgctaaaaagtttaatatcccaaagatcttgtttcatggcatgtgctgcttatgtttgttgtgtatgcatgttttgagaaagaatccaaagatcttggaaaatttgaagtctgataaggaacatttcgttgttccatacttcccagataagatcgaattaactagaccacaagttccaatggatacatacgttcctggtgaattaaaggaattcatggaagatttggttgaagctgataagacttcttacggtgttattgttaacacatttcaagaattggaaccagcatacgttaaggattacaaggaaactagatctggtaaagcttggtctgttggtccagttgctttgtgtaataaggcaagaatcgataaggctgaaagaggtaataagtctgatatcgatcaagatgaatgtttgaagtggttggattcaaaggaagaaagatctgttttgtacgtttgtttgggttcaatctgtaatttgccattggctcaattgaaggaattgggtttaggtttggaagaatctacaagaccttttatttgggttattagaggttgggataagaataagcaattggttgaatggttctctgaatcaggtttcgaagaaagaattaaagatagaggtttgttgattaaaggttggtcaccacaaatgttgatcttgtctcatcaatcagttggtggtttcttgactcattgtggttggaattctactttagaaggtattacagcaggtttgccattgttaacatggccattgttcgctgatcaattctgtaacgaaaagttagttgttcaagttttgaattcaggtgttagagcaggtgttgaacaaccaatgaaatggggtgaagaagaaaagattggtgttttggttgataaagaaggtgttaagaaagctgttgaagaattaatgggtgaatctgatgaagcaaacgaaagaagaagaagagctaaggaattaggcgaattggctcataaagcagttgaagaaggtggttcttcacattcaaacatcacatttttgttgcaagatatcatgcaattagctcaatctaataattaa

SEQ ID NO: 1063 - protein, 495 aa, Barbarea vulgaris
MASITNHKSDPLHFVLFPFMAQGHMIPMVDIARLLAQRGLTITIVTTPHNASRFKNVLNRAIESGLPINILHVKLPYQEVGLPEGLENIDCFDSMEHMIPFFKGVNMVEESVQKLFEEMSPRPSCIISDFCLPYTSKVAKKFNIPKILFHGMCCLCLLCMHVLRKNPKILENLKSDKEHFVVPYFPDKIELTRPQVPMDTYVPGELKEFMEDLVEADKTSYGVIVNTFQELEPAYVKDYKETRSGKAWSVGPVALCNKARIDKAERGNKSDIDQDECLKWLDSKEERSVLYVCLGSICNLPLAQLKELGLGLEESTRPFIWVIRGWDKNKQLVEWFSESGFEERIKDRGLLIKGWSPQMLILSHQSVGGFLTHCGWNSTLEGITAGLPLLTWPLFADQFCNEKLVVQVLNSGVRAGVEQPMKWGEEEKIGVLVDKEGVKKAVEELMGESDEANERRRRAKELGELAHKAVEEGGSSHSNITFLLQDIMQLAQSNN

SEQ ID NO: 1064 - DNA, 1494 bp, Barbarea vulgaris
atggcttctgcaaaattgcatcaattccatccatcattgcatttcgttttgttcccttttatggctcaaggtcatatgatcccaatgatcgatatcgctagattgttggcacaaagaggtgttactatcacaatcgttactacattgcataactctgctagattcagaaacgttttgtctagagcaatcgaatcaggtttgccaattaatttggttcatgttaagttcccatatcaagaagctggtttaccagaaggtcaagaaaacatcgattctttggattcaaaggaattaactgttccatttttcaaggcagttaacatgttggaagaaccagttatgaagttgatggaagaaatgaagccaagaccatcttgtttgatctcagatttgtgtttgccatatacatctaaaattgctaaaaagtttaatatcccaaagatcgttttccatggtatgggttgtttttgtttgttatgtatgcatgttttaagaagaaatttggaaattttgcaaaatttgaagtcagataaggaatacttctggatcccaaacttcccagatagagttgaattcactaaaccacaagttccagttagaattaatgcttctggtgactggaaagttttcttggatgaaatggttaaagcagaagaaacttcatatggtgttattgttaacacattccaagaattagaaccagcatacgttaaagattttcaagaagctagagctggtaaagtttggtctattggtccagtttcattgtgtaataagatcgaagctgataaagcagaaagaggtaataaggctgcaatcgatcaagatgaatgtttgaagtggttggattctaaagaaggtggttcagttttgtacgtttgtttgggttctatctgtaatttgccattggttcaattgattgaattgggtttaggtttggaagaatctcaaagaccttttatttgggttattagaggttgggaaaagtacaacgaattatcagaatggatctctgaatcaggtttcgaagaaagagttaaggatagaggtttgttgatcagaggttgggctccacaagttttaattttgtctcatccatcagttggtggtttcttgactcattgtggttggaattctactttagaaggtattacatcaggtgttccattgttaacattaccattgtttggtgaccaattttgtaaccaaaagttgatcgttcaagttttgaaagttggtgtttctgctggtgttgaagaagttatgggttggggtgaagaagaaaagattggtgttttggttgataaggaaagagttaagaaaactgtcgaagaagttatgggtgaatcagatgatgcaaaggaaagaagaagaagagttaaggaattgggtaaattggctcataaagcagttgaagaaggtggttcttcacattctaacatcacattatttttgcaagatatgtgtcaattacaatcagttggtatctattaa

SEQ ID NO: 1065 - protein, 497 aa, Barbarea vulgaris
MASAKLHQFHPSLHFVLFPFMAQGHMIPMIDIARLLAQRGVTITIVTTLHNSARFRNVLSRAIESGLPINLVHVKFPYQEAGLPEGQENIDSLDSKELTVPFFKAVNMLEEPVMKLMEEMKPRPSCLISDLCLPYTSKIAKKFNIPKIVFHGMGCFCLLCMHVLRRNLEILQNLKSDKEYFWIPNFPDRVEFTKPQVPVRINASGDWKVFLDEMVKAEETSYGVIVNTFQELEPAYVKDFQEARAGKVWSIGPVSLCNKIEADKAERGNKAAIDQDECLKWLDSKEGGSVLYVCLGSICNLPLVQLIELGLGLEESQRPFIWVIRGWEKYNELSEWISESGFEERVKDRGLLIRGWAPQVLILSHPSVGGFLTHCGWNSTLEGITSGVPLLTLPLFGDQFCNQKLIVQVLKVGVSAGVEEVMGWGEEEKIGVLVDKERVKKTVEEVMGESDDAKERRRRVKELGKLAHKAVEEGGSSHSNITLFLQDMCQLQSVGIY

SEQ ID NO: 1066 - DNA, 1575 bp, Barbarea vulgaris
atggcatcaatcactaaccataagtctgatccattgcatttcgttttgttcccttttatggctcaaggtcatatgattccaatggttgatattgctagattgttagcacaaagaggtttgactatcacaatcgttactacaccacataacgcatcaagattcaaaaacgttttgaatagagctattgaatctggtttgccaattaatatcttgcatgttaagttgccatatcaagaagtcggtttacctgaaggtttggaaaacatcgattgtttcgattcaatggaacatatgatcccatttttcaagggtgttaacatggttgaagaatctgttcaaaagttgttcgaagaaatgtctccaagaccatcatgtatcatctctgatttctgtttgccatacacatcaaaggttgctaaaaagtttaatatcccaaagatcttgtttcatggcatgtgctgcttatgtttgttgtgtatgcatgttttgagaaagaatccaaagatcttggaaaatttgaagtctgataaggaacatttcgttgttccatacttcccagataagatcgaattaactagaccacaagttccaatggatacatacgttcctggtgaattaaaggaattcatggaagatttggttgaagctgataagacttcatacggtgttattgttaacacatttcaagaattggaaccagcatacgttaaggattacaaggaaactagatctggtaaagcttggtctgttggtccagttgctttgtgtaataaggcaagaatcgataaggctgaaagaggtaataagtctgatatcgatcaagatgaatgtttgaagtggttggattcaaaggaagaaagatctgttttgtacgtttgtttgggttcaatctgtaatttgccattggctcaattgaaggaattgggtttaggtttggaagaatctacaagaccttttatttgggttattagaggttgggataagaataagcaattggttgaatggttctctgaatcaggtttcgaagaaagaattaaagatagaggtttgttgattaaaggttggtcaccacaaatgttgatcttgtctcatcaatcagttggtggtttcttgactcattgtggttggaattctactttagaaggtattacagcaggtttgccattgttaacatggccattgttcgctgatcaattctgtaacgaaaagttagttgttcaagttttgaattctggtgttagagcaggtgttgaacaaccaatgaaatggggtgaagaagaaaagattggtgttttggttgataaagaaggtgttaagaaagctgttgaagaattaatgggtgaatcagatgaagcaaacgaaagaagaagaagagctaaggaattaggcgaattggctcataaagcagttgaagaaggtggttcttcacattctaacatcacatttttgttgcaagatatcatgcaattggcacaaccaatcacagaaccatcatttttagttcaatcttggcattacaagaaagctttgttaattaatttgttacaaagaactggtcattaccaatctaaataa

SEQ ID NO: 1067 - protein, 524 aa, Barbarea vulgaris
MASITNHKSDPLHFVLFPFMAQGHMIPMVDIARLLAQRGLTITIVTTPHNASRFKNVLNRAIESGLPINILHVKLPYQEVGLPEGLENIDCFDSMEHMIPFFKGVNMVEESVQKLFEEMSPRPSCIISDFCLPYTSKVAKKFNIPKILFHGMCCLCLLCMHVLRKNPKILENLKSDKEHFVVPYFPDKIELTRPQVPMDTYVPGELKEFMEDLVEADKTSYGVIVNTFQELEPAYVKDYKETRSGKAWSVGPVALCNKARIDKAERGNKSDIDQDECLKWLDSKEERSVLYVCLGSICNLPLAQLKELGLGLEESTRPFIWVIRGWDKNKQLVEWFSESGFEERIKDRGLLIKGWSPQMLILSHQSVGGFLTHCGWNSTLEGITAGLPLLTWPLFADQFCNEKLVVQVLNSGVRAGVEQPMKWGEEEKIGVLVDKEGVKKAVEELMGESDEANERRRRAKELGELAHKAVEEGGSSHSNITFLLQDIMQLAQPITEPSFLVQSWHYKKALLINLLQRTGHYQSK

SEQ ID NO: 1068 - DNA, 1488 bp, Barbarea vulgaris
atggtttctgaaatcactcataagtcatacccattgcattttgttttgtttccttttatggctcaaggtcatatgattccaatggttgatattgctagattgttggcacaaagaggtgttaagatcacaatcgttactacaccacataacgctgcaagattcaaaaacgttttgtcaagagctattgaatctggtttgccaatctcaatcgttcaggttaagttgccatctcaagaagcaggtttgccagagggtaacgaaactttggattctttggtttcaatggaattaatgatccatttcttgaaggctgttaacatgttggaagaaccagttcaaaagttgttcgaagaaatgtctccacaaccatcatgtattatttctgatttttgtttaccatacacatctaaaattgctaaaaagtttaatatcccaaagatcttgttccatggcatgtgttgtttctgtttgttgtgtatgcatatcttaagaaagaatagagaaattgttgaaaatttgaaatcagataaggaacatttcgttgttccatacttcccagatagagttgaattcactagaccacaagttccagttgctacatacgttcctggtgactggcatgaaattactgaagatatggttgaagcagataagacttcttacggtgttattgttaacacataccaagaattagaaccagcttatgcaaatgattacaaagaagctagatctggtaaagcatggacaattggtccagtttcattgtgtaataaggttggtgctgataaagcagaaagaggtaataaggctgatatcgatcaagatgaatgtttgaagtggttgaactctaaggaagaaggttcagttttgtacgtttgtttgggttctatctgtaatttgccattgtcacaattgaaggaattgggtttgggtttggaagaatctcaaagaccttttatttgggttattagaggttgggaaaagaataaggaattgcatgaatggttctctgaatcaggtttcgaagaaagaattaaagatagaggtttgttgattaaaggttgggctccacaaatgttgatcttgtctcatcattcagttggtggtttcttgactcattgtggttggaattcaactttagaaggtttgacagcaggtttaccattgttaacatggccattgttcgctgatcaattctgtaacgaaaagttggcagttcaagttttgaaagctggtgtttctgcaggtgttgatcaaccaatgaaatggggtgaagaagaaaagattggtgttttggttgataaggaaggtgttaagaaagctgttgaagaattgatgggtgaatcagatgatgctaaggaaatcagaagaagagcaaaggaattaggcgaattggctcataaagcagttgaagaaggtggttcttcacattcaaacatcacttctttgttggaagatatcatgcaattggcacaatctaataattaa

SEQ ID NO: 1069 - protein, 495 aa, Barbarea vulgaris
MVSEITHKSYPLHFVLFPFMAQGHMIPMVDIARLLAQRGVKITIVTTPHNAARFKNVLSRAIESGLPISIVQVKLPSQEAGLPEGNETLDSLVSMELMIHFLKAVNMLEEPVQKLFEEMSPQPSCIISDFCLPYTSKIAKKFNIPKILFHGMCCFCLLCMHILRKNREIVENLKSDKEHFVVPYFPDRVEFTRPQVPVATYVPGDWHEITEDMVEADKTSYGVIVNTYQELEPAYANDYKEARSGKAWTIGPVSLCNKVGADKAERGNKADIDQDECLKWLNSKEEGSVLYVCLGSICNLPLSQLKELGLGLEESQRPFIWVIRGWEKNKELHEWFSESGFEERIKDRGLLIKGWAPQMLILSHHSVGGFLTHCGWNSTLEGLTAGLPLLTWPLFADQFCNEKLAVQVLKAGVSAGVDQPMKWGEEEKIGVLVDKEGVKKAVEELMGESDDAKEIRRRAKELGELAHKAVEEGGSSHSNITSLLEDIMQLAQSNN

SEQ ID NO: 1070 - DNA, 1488 bp, Barbarea vulgaris
atggtttcagaaatcactcataagtcttacccattgcattttgttttgtttccttttatggctcaaggtcatatgattccaatggttgatattgctagattgttggcacaaagaggtgttaagatcacaatcgttactacaccacataatgctgcaagattcgaaaacgttttgaacagagctattgaatcaggtttgccaatctctatcgttcaggttaagttgccatcacaagaagcaggtttgccagagggtaacgaaactttcgattctttagtttcaatggaattgttggttccatttttcaagtctgttaacatgttggaagaaccagttcaaaagttgttcgaagaaatgtctccacaaccatcatgtattatttctgatttttgtttaccatacacatcaaaaattgctaaaaagtttaatatcccaaagatcttgttccatggcatgtgttgtttctgtttgttgtgtatgcatgttttgagaaagaatcatgaaatcgttgaaaatttgaaatctgataaggaacatttcgttgttccatacttcccagatagagttgaattcactagaccacaagttccagttgctacatacgttcctggtgactggcatgaaattactggtgacatggttgaagcagataagacttcttacggtgttattgttaacacatgtcaagaattagaaccagcttatgcaaatgattacaaagaagctagatctggtaaagcatggacaattggtccagtttctttgtgtaataaggttggtgctgataaagcagaaagaggtaataaggctgatatcgatcaagatgaatgtttgaagtggttgaactcaaaggaagaaggttctgttttgtacgtttgtttgggttcaatctgtaatttgccattgtctcaattgaaggaattgggtttgggtttggaagaatcacaaagaccttttatttgggttattagaggttgggaaaagaataaggaattgttggaatggttctctgaatcaggtttcgaagaaagaattaaagatagaggtttgttgattaaaggttgggctccacaaatgttgatcttgtctcatcattcagttggtggtttcttgactcattgtggttggaattctactttagaaggtttgacagcaggtttaccattgttaacatggccattgttcgctgatcaattctgtaacgaaaagttggcagttcaagttttgaaagctggtgtttcagcaggtgttgatcaaccaatgaaatggggtgaagaagaaaagattggtgttttggttgataaggaaggtgttaagaaagctgttgaagaattgatgggtgaatctgatgatgctaaggaaatcagaagaagagcaaaggaattaggcgaattggctcataaagcagttgaagaaggtggttcttcacattcaaacatcacttctttgttggaagatatcatgcaattggcacaatctaataattaa

SEQ ID NO: 1071 - protein, 495 aa, Barbarea vulgaris
MVSEITHKSYPLHFVLFPFMAQGHMIPMVDIARLLAQRGVKITIVTTPHNAARFENVLNRAIESGLPISIVQVKLPSQEAGLPEGNETFDSLVSMELLVPFFKSVNMLEEPVQKLFEEMSPQPSCIISDFCLPYTSKIAKKFNIPKILFHGMCCFCLLCMHVLRKNHEIVENLKSDKEHFVVPYFPDRVEFTRPQVPVATYVPGDWHEITGDMVEADKTSYGVIVNTCQELEPAYANDYKEARSGKAWTIGPVSLCNKVGADKAERGNKADIDQDECLKWLNSKEEGSVLYVCLGSICNLPLSQLKELGLGLEESQRPFIWVIRGWEKNKELLEWFSESGFEERIKDRGLLIKGWAPQMLILSHHSVGGFLTHCGWNSTLEGLTAGLPLLTWPLFADQFCNEKLAVQVLKAGVSAGVDQPMKWGEEEKIGVLVDKEGVKKAVEELMGESDDAKEIRRRAKELGELAHKAVEEGGSSHSNITSLLEDIMQLAQSNN

SEQ ID NO: 1072 - DNA, 951 bp, Cucumis melo
atggatgccattcaacatactaccatcaaaacgaatggcataaaaatgcatattgcgagtgtagggaatggacctgtcgtgttactcttacacggttttcccgaattgtggtattcttggagacatcaactcctttatctgagttcagtgggatatcgcgcaatagctccagatttgagaggatacggtgataccgattctccagaaagccatacctcttatacagcgttacacattgttggagatctagtaggtgctttagacgagttaggcattgaaaaggtcttcttggttgggcatgattggggtgccataatagcctggtatttctgcctatttagaccagagaggatcaaagcattggtcaacctttcagtccaattctttccacgtaatccggctatctcgttcattcagcgatttagagctgcatatggggatgatttctacatgtgtaggttccaagttccaggagaagctgaagcagattttgcctgtattgacacagcacaactgttcaaaactaccctatctaacagatccacgaaagctccgtgtttgcctaaagaatacggttttagggctattccaccacctgagaatttgccttcatggctaactgaagaagacatcaactactatgcagcgaagtttaaggaaactggttttacaggcgctttgaactactatcgtgcctttgatcttacttgggaactgactgctccttggacaggtgttcagattcaagtgcctgttaagttcatagtaggtgattccgacttaacataccattttaagggtgcaaaggagtacattcatgaaggtggctttaaaagagacgtacccttattggaagaggttgttatcgtggaaaatgccggtcattttgttcacgaagaaaaaccccatgagataaatacacacattcacgacttcatcaagaaattttaa

SEQ ID NO: 1073 - protein, 316 aa, Cucumis melo
MDAIQHTTIKTNGIKMHIASVGNGPVVLLLHGFPELWYSWRHQLLYLSSVGYRAIAPDLRGYGDTDSPESHTSYTALHIVGDLVGALDELGIEKVFLVGHDWGAIIAWYFCLFRPERIKALVNLSVQFFPRNPAISFIQRFRAAYGDDFYMCRFQVPGEAEADFACIDTAQLFKTTLSNRSTKAPCLPKEYGFRAIPPPENLPSWLTEEDINYYAAKFKETGFTGALNYYRAFDLTWELTAPWTGVQIQVPVKFIVGDSDLTYHFKGAKEYIHEGGFKRDVPLLEEVVIVENAGHFVHEEKPHEINTHIHDFIKKF

SEQ ID NO: 1074 - protein, 484 aa, Medicago truncatula
MGTESKPLKIYMLPFFAQGHLIPLVNLARLVASKNQHVTIITTPSNAQLFDKTIEEEKAAGHHIRVHIIKFPSAQLGLPTGVENLFAASDNQTAGKIHMAAHFVKADIEEFMKENPPDVFISDIIFTWSESTAKNLQIPRLVFNPISIFDVCMIQAIQSHPESFVSDSGPYQIHGLPHPLTLPIKPSPGFARLTESLIEAENDSHGVIVNSFAELDEGYTEYYENLTGRKVWHVGPTSLMVEIPKKKKVVSTENDSSITKHQSLTWLDTKEPSSVLYISFGSLCRLSNEQLKEMANGIEASKHQFLWVVHGKEGEDEDNWLPKGFVERMKEEKKGMLIKGWVPQALILDHPSIGGFLTHCGWNATVEAISSGVPMVTMPGFGDQYYNEKLVTEVHRIGVEVGAAEWSMSPYDAKKTVVRAERIEKAVKKLMDSNGEGGEIRKRAKEMKEKAWKAVQEGGSSQNCLTKLVDYLHSVVVTKSVELN

SEQ ID NO: 1075 - DNA, 1455 bp, Medicago truncatula
atgggtactgaatctaagccattgaagatctatatgttgccatttttcgctcaaggtcatttgatcccattggttaatttggctagattggttgcatctaaaaatcaacatgttactatcatcactacaccatcaaacgctcaattgttcgataagacaatcgaagaagaaaaagctgcaggtcatcatatcagagttcatattattaagttcccatctgcacaattgggtttaccaactggtgttgaaaatttgttcgctgcatcagataaccaaacagctggtaaaatccatatggctgcacatttcgttaaggcagatatcgaagaattcatgaaggaaaatccaccagatgtttttatttctgatatcatttttacttggtctgaatcaacagctaaaaatttgcaaatcccaagattggtttttaatccaatctcaatctttgatgtttgtatgattcaagcaattcaatctcatccagaatcatttgtttctgattcaggtccatatcaaattcatggtttgccacatccattgactttaccaattaaaccatctccaggtttcgctagattgacagaatcattgatcgaagcagaaaacgattctcatggtgttattgttaactcattcgctgaattggatgaaggttacactgaatactacgaaaatttgacaggtagaaaagtttggcatgttggtccaacttctttgatggttgaaatcccaaagaaaaagaaagttgtttctactgaaaacgattcttcaatcacaaagcatcaatcattgacttggttagatacaaaagaaccatcttcagttttgtacatctctttcggttcattgtgtagattgtctaacgaacaattgaaggaaatggctaacggtatcgaagcatcaaagcatcaattcttgtgggttgttcatggtaaagaaggtgaagatgaagataactggttgccaaagggtttcgttgaaagaatgaaggaagaaaagaaaggcatgttgattaaaggttgggttccacaagctttgattttagatcatccatctattggtggtttcttgactcattgtggttggaatgctacagttgaagcaatttcttcaggtgttccaatggttactatgccaggtttcggtgaccaatactacaacgaaaagttggttacagaagttcatagaattggtgttgaagttggtgctgcagaatggtctatgtcaccatatgatgctaagaaaactgttgttagagctgaaagaatcgaaaaggcagttaagaaattgatggattctaacggtgaaggtggtgaaatcagaaagagagcaaaggaaatgaaggaaaaagcttggaaagcagttcaagaaggtggttcttcacaaaactgtttgactaagttggttgattacttgcattctgttgttgttacaaagtcagttgaattaaattaa

SEQ ID NO: 1076 - protein, 465 aa, Medicago truncatula
MSMSDINKNSELIFIPAPGIGHLASALEFAKLLTNHDKNLYITVFCIKFPGMPFADSYIKSVLASQPQIQLIDLPEVEPPPQELLKSPEFYILTFLESLIPHVKATIKTILSNKVVGLVLDFFCVSMIDVGNEFGIPSYLFLTSNVGFLSLMLSLKNRQIEEVFDDSDRDHQLLNIPGISNQVPSNVLPDACFNKDGGYIAYYKLAERFRDTKGIIVNTFSDLEQSSIDALYDHDEKIPPIYAVGPLLDLKGQPNPKLDQAQHDLILKWLDEQPDKSVVFLCFGSMGVSFGPSQIREIALGLKHSGVRFLWSNSAEKKVFPEGFLEWMELEGKGMICGWAPQVEVLAHKAIGGFVSHCGWNSILESMWFGVPILTWPIYAEQQLNAFRLVKEWGVGLGLRVDYRKGSDVVAAEEIEKGLKDLMDKDSIVHKKVQEMKEMSRNAVVDGGSSLISVGKLIDDITGSN

SEQ ID NO: 1077 - DNA, 1398 bp, Medicago truncatula
atgtctatgtcagatatcaataagaactctgaattaattttcattccagctccaggtattggtcatttggcttcagcattggaatttgcaaagttgttgactaaccatgataagaatttgtatattacagttttctgtattaaatttcctggtatgccattcgctgattcttacatcaagtcagttttggcatctcaaccacaaatccaattgatcgatttgccagaagttgaaccaccaccacaagaattgttgaagtctccagaattctacatcttgacatttttggaatcattgatcccacatgttaaggctactattaaaacaatcttgtctaataaggttgttggtttggttttggatttcttttgtgtttcaatgatcgatgttggtaacgaattcggtatcccatcttacttgtttttaacatcaaacgttggtttcttgtcattgatgttgtctttgaaaaatagacaaatcgaagaagttttcgatgattctgatagagatcatcaattgttgaacatcccaggtatctctaaccaagttccatcaaacgttttgccagatgcttgtttcaataaggatggtggttacatcgcttactacaagttggcagaaagattcagagatactaagggtatcatcgttaacacattttctgatttggaacaatcttcaatcgatgctttgtacgatcatgatgaaaagattccaccaatctatgcagttggtccattgttagatttgaaaggtcaaccaaatccaaaattggatcaagcacaacatgatttgatcttgaagtggttggatgaacaacctgataagtctgttgttttcttgtgtttcggttcaatgggtgtttcttttggtccatcacaaatcagagaaatcgctttgggtttgaagcattcaggtgttagatttttatggtctaactcagcagaaaagaaagtttttccagaaggtttcttggaatggatggaattggagggtaaaggcatgatttgtggttgggctccacaagttgaagttttggctcataaagcaattggtggttttgtttctcattgtggttggaactctatcttggaatcaatgtggttcggtgttccaattttgacttggccaatctatgctgaacaacaattgaacgcttttagattggttaaggaatggggtgttggtttgggtttaagagttgattacagaaaaggttctgatgttgttgctgcagaagaaatcgaaaagggtttgaaggatttgatggataaagattctattgttcataagaaagttcaagaaatgaaggaaatgtcaagaaatgctgttgttgatggtggttcttcattgatctctgttggtaaattgatcgatgatatcacaggttcaaattaa

SEQ ID NO: 1078 - protein, 451 aa, Panax ginseng
MLSKTHIMFIPFPAQGHMSPMMQFAKRLAWKGVRITIVLPAQIRDSMQITNSLINTECISFDFDKDDGMPYSMQAYMGVVKLKVTNKLSDLLEKQKTNGYPVNLLVVDSLYPSRVEMCHQLGVKGAPFFTHSCAVGAIYYNAHLGKLKIPPEEGLTSVSLPSIPLLGRDDLPIIRTGTFPDLFEHLGNQFSDLDKADWIFFNTFDKLENEEAKWLSSQWPITSIGPLIPSMYLDKQLPNDKGNGINLYKADVGSCIKWLDAKDPGSVVYASFGSVKHNFGDDYMDEVAWGLLHSKYNFIWVVIEPERTKLSSDFLAEAEEKGLIVSWCPQLEVLSHKSIGSFMTHCGWNSTVEALSLGVPMVAVPQQFDQPVNAKYIVDVWQIGVRVPIGEDGVVLRGEVANCIKDVMEGEIGDELRGNALKWKGLAVEAMEKGGSSDKNIDEFISKLVSS

SEQ ID NO: 1079 - DNA, 1356 bp, Panax ginseng
atgttgtcaaagactcatatcatgttcatcccatttccagctcaaggtcatatgtctccaatgatgcaatttgctaaaagattagcatggaagggtgttagaatcacaatcgttttgccagcacaaattagagattcaatgcaaatcactaactctttgattaatacagaatgtatttcatttgatttcgataaggatgatggtatgccatactctatgcaagcttacatgggtgttgttaagttgaaggttactaataagttgtctgatttgttggaaaagcaaaagactaacggttacccagttaatttgttggttgttgattcattgtacccatctagagttgaaatgtgtcatcaattgggtgttaaaggtgctccatttttcactcattcttgtgctgttggtgcaatctattacaacgcacatttgggtaaattgaagattccaccagaagaaggtttgacatctgtttcattaccatcaattccattgttaggtagagatgatttgccaatcatcagaactggtacattcccagatttgttcgaacatttgggtaaccaattttctgatttggataaggctgattggattttctttaacactttcgataagttggaaaatgaagaagcaaaatggttgtcttcacaatggccaattacatcaatcggtccattgatcccatctatgtatttggataagcaattgccaaacgataagggtaacggtattaatttgtacaaggctgatgttggttcatgtattaaatggttggatgctaaagatccaggttctgttgtttacgcatctttcggttcagttaagcataacttcggtgacgattacatggatgaagttgcatggggtttgttgcattcaaagtacaacttcatctgggttgttattgaaccagaaagaactaagttgtcttcagatttcttggctgaagcagaagaaaaaggtttgattgtttcttggtgtccacaattggaagttttgtctcataagtcaatcggttcttttatgactcattgtggttggaattcaacagttgaagctttgtctttaggtgttccaatggttgcagttccacaacaattcgatcaaccagttaacgctaagtacatcgttgatgtttggcaaattggtgttagagttccaattggtgaagatggtgttgttttgagaggtgaagttgctaactgtatcaaggatgttatggaaggtgaaattggtgacgaattgcgtggtaatgcattaaaatggaaaggtttggctgttgaagcaatggaaaaaggtggttcttcagataagaacatcgatgaattcatttctaaattggtttcttcataa

SEQ ID NO: 1080 - protein, 473 aa, Panax ginseng
MKSELIFLPAPAIGHLVGMVEMAKLFISRHENLSVTVLIAKFYMDTGVDNYNKSLLTNPTPRLTIVNLPETDPQNYMLKPRHAIFPSVIETQKTHVRDIISGMTQSESTRVVGLLADLLFINIMDIANEFNVPTYVYSPAGAGHLGLAFHLQTLNDKKQDVTEFRNSDTELLVPSFANPVPAEVLPSMYVDKEGGYDYLFSLFRRCRESKAIIINTFEELEPYAINSLRMDSMIPPIYPVGPILNLNGDGQNSDEAAVILGWLDDQPPSSVVFLCFGSYGSFQENQVKEIAMGLERSGHRFLWSLRPSIPKGETKLQLKYSNLKEILPVGFLDRTSCVGKVIGWAPQVAVLAHKAVGGFVSHCGWNSILESVWYDMSVATWPMYGEQQLNAFEMVKELGLAVEIEVDYRNEYNKTGFIVRADEIETKIKKLMMDEKNSEIRKKVKEMKEKSRVAMSENGSSYTSLAKLFEKIM

SEQ ID NO: 1081 - DNA, 1422 bp, Panax ginseng
atgaaatctgaattgattttcttgccagctccagcaattggtcatttggttggtatggttgaaatggcaaagttgtttatttctagacatgaaaatttgtcagttactgttttgatcgctaagttctacatggatacaggtgttgataactacaataagtctttgttgactaatccaacaccaagattgactattgttaatttgccagaaacagatccacaaaactacatgttgaagccaagacatgcaatcttcccatctgttattgaaactcaaaagactcatgttagagatatcatctctggtatgactcaatctgaatcaacaagagttgttggtttgttagcagatttgttgtttattaacatcatggatatcgctaacgaattcaatgttccaacttacgtttactctccagctggtgcaggtcatttgggtttagctttccatttgcaaacattgaacgataagaaacaagatgttactgaattcagaaactctgatacagaattgttagttccatcatttgcaaatccagttccagctgaagttttaccatctatgtacgttgataaggaaggtggttacgattacttgttttctttgtttagaagatgtagagaatcaaaggcaatcattattaacactttcgaagaattggaaccatacgctattaattctttgagaatggattcaatgattccaccaatctatccagttggtccaattttgaatttgaatggtgacggtcaaaattctgatgaagctgcagttattttgggttggttagatgatcaaccaccatcttcagttgttttcttgtgtttcggttcttacggttcattccaagaaaaccaagttaaggaaatcgctatgggtttggaaagatcaggtcatagatttttgtggtctttaagaccatcaattccaaaaggtgaaactaaattgcaattgaagtactctaatttgaaggaaatcttgccagttggtttcttggatagaacatcatgtgttggtaaagttattggttgggcaccacaagttgctgttttggcacataaagctgttggtggttttgtttctcattgtggttggaactctatcttggaatcagtttggtacgatatgtcagttgctacttggccaatgtacggtgaacaacaattgaacgcattcgaaatggttaaggaattgggtttagctgttgaaatcgaagttgattacagaaacgaatacaataagactggttttattgttagagctgatgaaatcgaaacaaaaattaagaaattgatgatggatgaaaagaattctgaaattagaaagaaagttaaagaaatgaaggaaaaatctagagttgcaatgtcagaaaatggttcttcatatacatcattggctaaattatttgaaaagattatgtaa

SEQ ID NO: 1082 - protein, 454 aa, Catharanthus roseus
MATEQQQASISCKILMFPWLAFGHISSFLQLAKKLSDRGFYFYICSTPINLDSIKNKINQNYSSSIQLVDLHLPNSPQLPPSLHTTNGLPPHLMSTLKNALIDANPDLCKIIASIKPDLIIYDLHQPWTEALASRHNIPAVSFSTMNAVSFAYVMHMFMNPGIEFPFKAIHLSDFEQARFLEQLESAKNDASAKDPELQGSKGFFNSTFIVRSSREIEGKYVDYLSEILKSKVIPVCPVISLNNNDQGQGNKDEDEIIQWLDKKSHRSSVFVSFGSEYFLNMQEIEEIAIGLELSNVNFIWVLRFPKGEDTKIEEVLPEGFLDRVKTKGRIVHGWAPQARILGHPSIGGFVSHCGWNSVMESIQIGVPIIAMPMNLDQPFNARLVVEIGVGIEVGRDENGKLKRERIGEVIKEVAIGKKGEKLRKTAKDLGQKLRDREKQDFDELAATLKQLCV

SEQ ID NO: 1083 - DNA, 1365 bp, Catharanthus roseus
atggctactgaacaacaacaagcatcaatctcttgtaagatcttgatgttcccatggttggcattcggtcatatctcttcatttttgcaattggctaagaaattgtctgatagaggtttctacttctacatctgttcaacaccaattaatttggattctattaaaaataagattaatcaaaactattcttcatctatccaattggttgatttgcatttgccaaattcaccacaattgccaccatctttacatactacaaatggtttgccaccacatttgatgtcaactttgaaaaatgctttgatcgatgcaaacccagatttgtgtaagatcatcgcatctattaaaccagatttgatcatctatgatttgcatcaaccatggactgaagctttggcatcaagacataacatcccagctgtttcattttctacaatgaacgctgtttctttcgcatacgttatgcatatgttcatgaacccaggtatcgaattcccttttaaagctatccatttgtctgatttcgaacaagcaagatttttggaacaattggaatcagctaaaaatgatgcttctgcaaaagatccagaattgcaaggttcaaagggtttctttaactctacttttattgttagatcatctagagaaatcgagggtaaatacgttgattacttgtcagaaatcttgaagtctaaagttattccagtttgtccagttatttcattgaacaacaacgatcaaggtcaaggtaataaggatgaagatgaaatcatccaatggttggataagaaatctcatagatcatctgttttcgtttcattcggttctgaatactttttgaacatgcaagaaatcgaagaaatcgctatcggtttggaattatctaacgttaacttcatctgggttttgagattcccaaagggtgaagatactaagatcgaagaagttttgccagaaggtttcttggatagagttaagacaaagggtagaatcgttcatggttgggctccacaagcaagaattttgggtcatccatcaattggtggttttgtttctcattgtggttggaactcagttatggaatctatccaaatcggtgttccaatcatcgcaatgccaatgaatttggatcaaccttttaatgctagattggttgttgaaattggtgttggtattgaagttggtagagatgaaaacggtaaattgaagagagaaagaatcggtgaagttattaaagaagttgcaatcggtaaaaagggtgaaaagttgagaaagactgctaaggatttgggtcaaaagttgagagatagagaaaagcaagattttgatgaattggctgcaacattgaaacaattatgtgtttaa

SEQ ID NO: 1084 - protein, 478 aa, Gypsophila vaccaria
MSNNENNATQVIVLPYHGQGHMNTMVQFAKRLAWKGVHVTIATTFNTIQQMKLNISSYNSITLEPIYDDTDDSTLHIKDRMARFEAEAASNLTRVLEAKKQQQALNKKCLLVYHGSLNWALVVAHQQNVAGAAFFTAASASFACYYYLHLESQGKGVDLEELPSILPPPKVIVQKLPKSFLAYGDNNSHNNNNNNNNNNNNNNMGLHPLVLWLLKDYGNSVKADFVLLNSFDKLEEEAIKWISNICSVKTIGPTIPSTYLDKQIENDVDYGFNQYKPTNEDCMKWLDTKEANSVVYIAFGSVARLSVEQMAEIAKALDHSSKSFIWVVRETEKEKLPVDLVEKISGQGMVVPWAPQLEVLAHDAVGCFVSHCGWNSTIEALSFGVPILAMPQFLDQLVDAHFVDRVWGVGIAPTVDENDLVTQEEISRCLDEMMGGGPEGEKIKKNVAMWKELTKEALDKGGSSDKHIDEIIEWLSSS

SEQ ID NO: 1085 - DNA, 1437 bp, Gypsophila vaccaria
atgtctaacaacgaaaacaacgctacacaagttattgttttgccataccatggtcaaggtcatatgaacactatggttcaattcgctaagagattagcatggaaaggtgttcatgttacaattgcaactacttttaatactatccaacaaatgaagttgaatatttcttcatacaattctattacattagaaccaatctatgatgatactgatgattcaacattgcatatcaaggatagaatggctagatttgaagcagaagctgcatctaatttgactagagttttggaagctaagaaacaacaacaagcattgaataagaaatgtttgttggtttaccatggttcattgaattgggctttagttgttgcacatcaacaaaatgttgctggtgctgctttctttacagctgcatcagcttctttcgcatgttactactatttgcatttggaatctcagggtaaaggtgttgatttggaagaattaccatcaatcttgccaccaccaaaagttattgttcaaaagttgccaaagtcatttttggcttacggtgacaataattcacataacaataataataataacaataataacaataataataataatatgggtttgcatccattggttttgtggttgttgaaggattacggtaactctgttaaagctgatttcgttttgttgaactcattcgataagttggaagaagaagcaattaaatggatctcaaacatctgttctgttaagactatcggtccaacaattccatctacttacttagataagcaaatcgaaaatgatgttgattacggttttaatcaatataaaccaacaaatgaagattgtatgaaatggttggatactaaggaagctaactcagttgtttacatcgctttcggttcagttgcaagattgtctgttgaacaaatggcagaaatcgctaaggcattggatcattcttcaaagtcttttatttgggttgttagagaaacagaaaaggaaaagttgccagttgatttggttgaaaagatttcaggtcagggtatggttgttccatgggctccacaattggaagttttagctcatgatgcagttggttgttttgtttcacattgtggttggaattctactattgaagctttgtcatttggtgttccaattttagcaatgccacaattcttggatcaattggttgatgctcatttcgttgatagagtttggggtgttggtattgcaccaacagttgatgaaaacgatttggttactcaagaagaaatctctagatgtttggatgaaatgatgggtggtggtccagaaggtgaaaagattaagaaaaatgttgctatgtggaaggaattgactaaggaagcattggataaaggtggttcttcagataaacatattgatgaaattattgaatggttatcttcatcttaa

SEQ ID NO: 1086 - protein, 497 aa, Medicago truncatula
MEGVEVEQPLKVYFIPFLASGHMIPLFDIATMFASRGQQVTVITTPANAKSLTKSLSSDAPSFLRLHTVDFPSQQVGLPEGIESMSSTTDPTTTWKIHTGAMLLKEPIGDFIENDPPDCIISDSTYPWVNDLADKFQIPNITFNGLCLFAVSLVETLKTNNLLKSQTDSDSDSSSFVVPNFPHHITLCGKPPKVIGIFMGMMLETVLKSKALIINNFSELDGEECIQHYEKATGHKVWHLGPTSLIRKTAQEKSERGNEGAVNVHESLSWLDSERVNSVLYICFGSINYFSDKQLYEMACAIEASGHPFIWVVPEKKGKEDESEEEKEKWLPKGFEERNIGKKGLIIRGWAPQVKILSHPAVGGFMTHCGGNSTVEAVSAGVPMITWPVHGDQFYNEKLITQFRGIGVEVGATEWCTSGVAERKKLVSRDSIEKAVRRLMDGGDEAENIRLRAREFGEKAIQAIQEGGSSYNNLLALIDELKRSRDLKRLRDLKLDD

SEQ ID NO: 1087 - DNA, 1494 bp, Medicago truncatula
atggaaggtgttgaagttgaacaaccattgaaggtttacttcatcccatttttagcttctggtcatatgatcccattgttcgatatcgctacaatgttcgcatcaagaggtcaacaagttactgttattactacaccagctaacgcaaagtcattgacaaagtctttatcttcagatgcaccatcatttttgagattgcatactgttgattttccatctcaacaagttggtttaccagaaggtattgaatcaatgtcttcaactacagatccaactacaacttggaagatccatactggtgctatgttgttgaaggaaccaatcggtgacttcatcgaaaacgatccaccagattgtatcatctcagattctacatacccatgggttaatgatttggctgataagttccaaatcccaaacatcacttttaatggtttgtgtttgttcgcagtttctttggttgaaacattgaagactaacaatttgttgaagtcacaaacagattcagattctgattcttcatctttcgttgttccaaacttcccacatcatatcactttgtgtggtaaaccaccaaaagttattggtatttttatgggtatgatgttggaaacagttttgaagtcaaaggctttgattattaacaatttttctgaattggatggtgaagaatgtatccaacattacgaaaaggcaacaggtcataaggtttggcatttgggtccaacatcattgatcagaaagactgctcaagaaaaatctgaacgtggtaatgaaggtgcagttaatgttcatgaatcattgtcttggttagattcagaaagagttaattctgttttatacatttgttttggttcaattaattacttctctgataagcaattgtacgaaatggcttgtgcaattgaagcttctggtcatccttttatttgggttgttccagaaaagaaaggtaaagaagatgaatcagaagaagaaaaggaaaagtggttgccaaagggtttcgaagaaagaaacatcggtaaaaagggtttgatcattagaggttgggctccacaagttaaaattttgtctcatccagcagttggtggttttatgacacattgtggtggtaattcaactgttgaagctgtttctgcaggtgttccaatgattacatggccagttcatggtgaccaattctacaacgaaaagttgatcactcaattcagaggtattggtgttgaagttggtgctacagaatggtgtacttctggtgttgcagaaagaaagaaattggtttcaagagattctatcgaaaaggcagttagaagattgatggatggtggtgacgaagctgaaaacatcagattgagagcaagagaatttggtgaaaaagctattcaagcaattcaagaaggtggttcatcttacaacaatttgttggctttgattgatgaattaaaaagatctagagatttgaaaagattaagagatttgaaattagatgattaa

SEQ ID NO: 1088 - protein, 476 aa, Glycine max
MDLQQRPLKLHFIPYLSPGHVIPLCGIATLFASRGQHVTVITTPYYAQILRKSSPSLQLHVVDFPAKDVGLPDGVEIKSAVTDLADTAKFYQAAMLLRRPISHFMDQHPPDCIVADTMYSWADDVANNLRIPRLAFNGYPLFSGAAMKCVISHPELHSDTGPFVIPDFPHRVTMPSRPPKMATAFMDHLLKIELKSHGLIVNSFAELDGEECIQHYEKSTGHKAWHLGPACLVGKRDQERGEKSVVSQNECLTWLDPKPTNSVVYVSFGSVCHFPDKQLYEIACALEQSGKSFIWIVPEKKGKEYENESEEEKEKWLPKGFEERNREKGMIVKGWAPQLLILAHPAVGGFLSHCGWNSSLEAVTAGVPMITWPVMADQFYNEKLITEVRGIGVEVGATEWRLVGYGEREKLVTRDTIETAIKRLMGGGDEAQNIRRRSEELAEKAKQSLQEGGSSHNRLTTLIADLMRLRDSKSAT

SEQ ID NO: 1089 - DNA, 1431 bp, Glycine max
atggatttgcaacaaagaccattgaagttgcatttcatcccatatttgtctccaggtcatgttattccattgtgtggtattgctacattatttgcatcaagaggtcaacatgttactgttattactacaccatactacgctcaaatcttgagaaaatcttcaccatctttgcaattacatgttgttgattttccagctaaagatgttggtttaccagatggtgttgaaattaaatcagcagttacagatttggctgatactgcaaaattttaccaagctgcaatgttgttgagaagaccaatctctcatttcatggatcaacatccaccagattgtatcgttgctgatacaatgtactcatgggctgatgatgttgcaaacaatttgagaatcccaagattggcttttaatggttacccattattttctggtgctgcaatgaagtgtgttatctctcatccagaattgcattcagatactggtccatttgttattccagattttccacatagagttacaatgccatcaagaccaccaaaaatggctactgcttttatggatcatttgttgaagatcgaattgaaatctcatggtttgatcgttaactcattcgctgaattagatggtgaagaatgtatccaacattacgaaaaatctacaggtcataaggcttggcatttgggtccagcatgtttagttggtaaaagagatcaagaaagaggtgaaaaatctgttgtttcacaaaacgaatgtttgacatggttagatccaaagccaactaactcagttgtttacgtttctttcggttcagtttgtcatttcccagataagcaattgtacgaaattgcttgtgcattggaacaatctggtaaatcttttatttggatcgttccagaaaagaaaggtaaagaatacgaaaacgaatctgaagaagaaaaggaaaagtggttgccaaagggtttcgaagaaagaaacagagaaaagggtatgattgttaaaggttgggctccacaattgttaattttggctcatccagcagttggtggtttcttgtctcattgtggttggaattcttcattggaagctgttacagcaggtgttccaatgattacttggccagttatggctgatcaattctacaacgaaaagttgatcacagaagttagaggtattggtgttgaagttggtgcaactgaatggagattagttggttacggtgaaagagaaaagttggttactagagatacaatcgaaactgctattaaaagattgatgggtggtggtgacgaagcacaaaacatcagaagaagatctgaagaattggctgaaaaagcaaaacaatcattacaagaaggtggttcttcacataacagattgactacattgatcgctgatttgatgagattgagagattctaagtcagcaacttaa

SEQ ID NO: 1090 - protein, 497 aa, Barbarea vulgaris
MASEKPHQCHPSLHFVLFPFMAQGHMIPMIDIARLLAHRGPKITIVTTPQNAARFKNVLSRSIDSGLPINVVHVKLPYQEAGLPEGQENADLLDSTEFMVPFFKAVNMLEEPVMKLMEEMKPRPSCLISDFCLPYTSKIAKKFNIPKIVFHGMGCFCLLCLYVLRQNLEILQNLKSDKEYFWMPSFPDRVEFTKPQVPVRTNASGDWKVFLDERVKGEETSYGVIVNTFQELEPAYVNDYKKARAGKVWSIGPVSLCNKVEADKAERGNKPVINQEQCIKWLDSKEEGSVLYVCLGSICNLPLPQLKELGLGLEESQRPFIWVTRGWEKYDELSEWLLESGFEERTKERGLLIKGWSPQMLILSHPAVGGFLTHCGWNSTLEGITSGVPLLTWPLFGDQFCNQKLVVQVLKVGVSAGVEEVMEWGDEEKIGVLIDKEGVKKAVEELMGESDDAKERRKRVKELGELAHKALEEGGSSHSNITLFLQDIMQQVESRTD

SEQ ID NO: 1091 - DNA, 1494 bp, Barbarea vulgaris
atggcttctgaaaaaccacatcaatgtcatccatcattgcatttcgttttgttcccttttatggcacaaggtcatatgatcccaatgatcgatatcgctagattgttggcacatagaggtccaaagatcactatcgttactacaccacaaaacgctgcaagattcaaaaacgttttgtctagatcaatcgattctggtttgccaattaatgttgttcatgttaagttgccatatcaagaagctggtttaccagaaggtcaagaaaacgcagatttgttggattcaactgaattcatggttccatttttcaaggctgttaacatgttggaagaaccagttatgaagttgatggaagaaatgaagccaagaccatcttgtttgatctcagatttctgtttgccatacacatctaaaattgctaaaaagtttaatatcccaaagatcgttttccatggtatgggttgtttctgtttgttgtgtttgtacgttttgagacaaaatttggaaattttgcaaaatttgaaatctgataaagaatacttttggatgccatcatttccagatagagttgaattcactaaaccacaagttccagttagaacaaatgcttctggtgactggaaagttttcttggatgaaagagttaaaggtgaagaaacttcatatggtgttattgttaacacattccaagaattagaaccagcatacgttaacgattacaagaaagctagagctggtaaagtttggtctattggtccagtttcattgtgtaataaggttgaagctgataaagcagaaagaggtaataagccagttattaatcaagaacaatgtatcaagtggttggattctaaagaagaaggttcagttttgtacgtttgtttgggttctatctgtaatttgccattgccacaattgaaagaattgggtttaggtttggaagaatcacaaagaccttttatttgggttactagaggttgggaaaaatacgatgaattgtctgaatggttgttggaatcaggtttcgaagaaagaacaaaggaaagaggtttgttgattaaaggttggtctccacaaatgttaattttgtcacatccagctgttggtggtttcttgactcattgtggttggaattctactttagaaggtattacatcaggtgttccattgttaacatggccattgttcggtgaccaattctgtaaccaaaagttggttgttcaagttttgaaagttggtgtttctgctggtgttgaagaagttatggaatggggtgacgaagaaaagattggtgttttgatcgataaggaaggtgttaagaaagctgttgaagaattaatgggtgaatctgatgatgcaaaggaaagaagaaagagagttaaggaattgggtgaattagctcataaagcattagaagaaggtggttcttcacattctaacatcactttatttttgcaagatatcatgcaacaagttgaatcaagaacagattaa

SEQ ID NO: 1092 - protein, 498 aa, Barbarea vulgaris
  subsp. arcuata
MASEKSHLFDPSLHFVIFPFMAQGHMIPMIDIARLLAQRGAKITIVTNPHNAARFYNVLSRSIESGLPINLEHVKLPYQEAGLSEGQENIDSLDSMELMVPFIKAVNLLEEPVMKLMEEIKPRPSCLISDLLLPYTSKITKKFNIPKIVFHGMGCFCLLCMHVLRRNIEILKNLKSDKDYFLVPSFPDRVEFTKPQVPVETNASGDWKEFLDEMVEAEDTSYGVIVNTFQELEPAYIKDYKEAKAGKVWSIGPVSLCNKIGADKAERGNKAAIEQDECLKWLDSKEEGSVLYVCLGSICNLPLAQLKELGLGLEESQRPFIWVTRGWEKYDELYEWMLESGFEERTKDRGLLIRGWAPQVLILSHPSVGGFLTHCGWNSTLEGITSGVPLLTWPLFGDQFCNQKLVMQVLKVGVSTGVEEIMKWGEEEKIGVLVDKEGVKKAVEELMGESDDAKERRKRVKELGKLAHKAVEEGGSSHCNITLFLQDICQLQSVKYFK

SEQ ID NO: 1093 - DNA, 1497 bp, Barbarea vulgaris
  subsp. arcuata
atggcatctgaaaaatcacatttgttcgatccatctttgcatttcgttatcttcccttttatggctcaaggtcatatgatcccaatgatcgatatcgctagattgttggcacaaagaggtgctaagatcactatcgttacaaacccacataacgctgcaagattctacaacgttttgtctagatcaatcgaatctggtttgccaattaatttggaacatgttaagttgccataccaagaagcaggtttgtcagaaggtcaagaaaacatcgattctttggattcaatggaattaatggttccttttattaaggctgttaatttgttggaagaaccagttatgaagttgatggaagaaattaaaccaagaccatcttgtttgatctcagatttgttattgccatacacttcaaagatcactaaaaagtttaatattccaaagatcgttttccatggtatgggttgtttctgtttgttgtgtatgcacgttttgagaagaaacatcgaaatcttgaaaaatttgaagtctgataaggattactttttggttccatcatttccagatagagttgaattcactaaaccacaagttccagttgaaacaaatgcatctggtgactggaaagaatttttggatgaaatggttgaagctgaagatacttcatacggtgttattgttaacacattccaagaattagaaccagcttacatcaaggattacaaggaagctaaagctggtaaagtttggtctattggtccagtttcattgtgtaataagattggtgctgataaagcagaaagaggtaataaggctgcaatcgaacaagatgaatgtttgaagtggttggattctaaagaagaaggttcagttttgtacgtttgtttgggttctatctgtaatttgccattggcacaattgaaggaattaggtttgggtttggaagaatcacaaagaccttttatttgggttactagaggttgggaaaagtacgatgaattgtacgaatggatgttggaatctggtttcgaagaaagaacaaaggatagaggtttgttgatcagaggttgggctccacaagttttgattttatctcatccatcagttggtggtttcttgactcattgtggttggaattctactttagaaggtattacatcaggtgttccattattgacatggccattgttcggtgaccaattctgtaaccaaaagttggttatgcaagttttgaaagttggtgtttctactggtgttgaagaaatcatgaagtggggtgaagaagaaaagattggtgttttggttgataaagaaggtgttaagaaagcagttgaagaattaatgggtgaatcagatgatgctaaggaaagaagaaagagagttaaggaattgggtaaattggctcataaagcagttgaagaaggtggttcttcacattgtaatattacattgtttttacaagatatttgtcaattacaatctgttaaatattttaaataa

SEQ ID NO: 1094 - protein, 461 aa, Citrullus lanatus
MDVHKAKDKPTTILMFPWIGYGHLSAYLELAKAVSRCRNNFQIYFCSTPVNLDSIRPKLVASSSSSSSSSIQFVELHLPSSPEFPPHLHTTNALPPHLTPTLHQAFAAAAPRFESILQTLSPHLLIYDVLQPWAPRIASSLNIPAINFNTTATSIISHALHNIHYPNSKFPLSDFVLHNYWKAKYTNVDGTTTERGRRVREAFLYCLTASHDVILINSFKEMEGKYMDYLSVMLKKRVIAVGPLVYEPSEDEDEEDEDYSRIKNWLDKKEASSTVLVAFGSEFFPSKEEMEEIAIGLEKSGANFIWVVRFPKGEERKRIEELLPEGFVERAGERAMVEKDWAPQGKILKHRSIGGFVSHCGWNSVMESIMLGVPVIGVPMHVDQPYNAGLLEEAGVGVEAKRDPDGKIQRQEIANLIRQVVVDKSREDLRMKVREMSEILRRKGDQKIDEMLTQISLLLKI

SEQ ID NO: 1095 - protein, 448 aa, Citrullus lanatus
MAADKQTTKKILMLPWLAHGHITPFFELAKRLSKSFQIYLCSSPINLQAINPTLARDHSIELISLHLLSLPDLPAHMHTTKGIPLHLEPTLVKAFDMAAHGFELLLDRLAPDLVVSDLFQPWAVRSASSRNIPVVSFVVTGVAVLARLVNGFWNNGQEFPFPEVDLSEHWVSKSSVRKVCDEVGHDWAMRFFECMRMSCDVALVNTSPEFEGKYIEFLASSLKKKVLPIAPLIPQIEPNNEKSEILEWLDRKTPKSTVYVSFGSEYYLTKQDREELAHGLHQSGVNFIWVIRFPKGQNLIIQEALPNDFLTQIEGKGLILNEWVPQLKILNHSSIGGFVCHCGWNSVVESMVFGVPIVALPMQLDQPYHAKVVECAGVCVEAKRDGEGNVKREEIVKAIKEVMFEKSGEALRGKAREIGEALRKREEGIIDEVVDEFCKLWEPESKGV

SEQ ID NO: 1096 - protein, 469 aa, Cucumis sativus
MAENKGLHVVVFPWSAFGHLIPHFQLSIALAKAGVHVSFISTPKNLQRLPPIPPSLSSFITLVPIPLPKLPGDPLPEGAEATVDIPFDKIPFLKVALDLTEPPFRKFIADHAHPPDWFIVDFNVSWIGDISREFRIPIVFFRVLSPGFLAFYAHLLGNRLPMTEIGSLISPPPIEGSTVAYRRHEAVGIHAGFFEKNDSGLSDYERVTKINTACRVIAVRTCYEFDVDYLKLYSNYCGKKVIPLGFLPPEKPPKTEFEANSPWKSTFEWLDQQNPKSVVFVGFGSECKLTKDQIHEIARGVELSELPFMWALRQPDWAEDSDVLPAGFRDRTAERGIVSMGWAPQMQILGHPAIGGSFFHGGWGSAIEALEFGNCLILLPFIVDQPLNARLLVEKGVAIEVERNEDDGCSSGEAIAKALREAMVSEEGEKIRKRAKEVAAIFGDTKLHQRYIEEFVEFLKHREDPIPNQ

SEQ ID NO: 1097 - protein, 489 aa, Cucumis sativus
MELDGHHRNKKKMKILMLPWLAHGHVSPFLELSKLLATKNFHIFFCSTSIILHSIRSKLPQKLLSSSNIQLVELTLPTSADLPRWRHTTAGLPSHLMFSLKRAFDSAASAFDGILQNLKPDLVIYDFLQPWAPAVALSADIPAVMFQCTGALMAAMVTNMLKFPNSDFLSTFPEIRLSEFEIKQLKNLFKSSVNDAKDKQRIEECYKRSCGILLLKSLREIEAKYIDFVSTSLQIKAIPVGPLVEEQEEDIVVLAESFEKWLNKKEKRSCILVSFGSEFYLSKGDMEEIAHGLELSHVNFIWVVRFPGSGEQGERKKKKNVVEEELPKGFLERVGERGMVVEEWVPQVQILKHRSTGGFLSHCGWSSVLESIKSGVPIIAAPMQLDQPLNARLVEHLGVGVVVERSDGGMLCRREVARAVREVVAEESGKRVREKVKEVAKIMKEKGDEGEMEVVVEEITKLCRRKRKGLQSNWCRTSMDSHCCEVMED

SEQ ID NO: 1098 - protein, 463 aa, Cucumis melo
MSNGDVLHVVLFPWLAFGHLIPFARLAICLAQKGFKVSFISTPRNLRRIPKISPHLSSVVSLVGVSLPLFDGLPVAAEASSDVPYNKQQLLKKAFDSLESQLADLLRDLNPDWIIYDYASHWISPLAAELRISSVFFSLFTAGFLAFLGPPSELSNGRGSRSTVEDFMEVPEWMSHGSNLRFRYHELKTSLDGAIGNESGTSDSVRFGVSIEESVAVAVRSSPELEPESFDLLTKLYQKPVIPIGFLPPLTEDVEELSEDIEQWLKKQKTNSVLYVSFGTEAFLSQEDVTELAYGLEQSEIPFLWILRTSHRNESEMLPAGFKERISGRGLVHEGWISQVKVLSHDSVGGCLTHCGWNSIIEGLGYGRVMIMCPVVNDQGLNARILEKEMVGIEIERNERDGSFTRESVSESVRSAMAEGSGGGKLLRERAMEMKGLFGNGDKNERDLDKLVDFLKTNRKNAA

SEQ ID NO: 1099 - protein, 467 aa, Cucumis melo
MTGDKNLHIVMFPWLAFGHMIPYLELSKLIAQKGHRVSFVSTPKNIDRLPTQLPPHLSPFLSFVKIPLPQLHNLPPDAEATSDLPYDKVQFLKEAFDALKQPLSDFLRTSDADWIVYDFVPYWIGQEVGPNLRIKTAFFSIFILQSLAFVGPMLGDRRMKLEDFTVPPDWIPFPTTVAFRHFEIKKLFDFVAGNTTGVSDIDRFKMSAHYSDLVVVRAFPEYEPEWIQLLEDIHDKTVIPVGQLPTSEHDSKEDNRSWQSIKEWLDKQAKGSVVYVAFGSEAKPSQHELTEIALGLEKSRFPFFWVLRTRLGLSDPDPIELPEGFEERTKGQGVVCTTWAPQLKILGHESVGGFLTHSGWSSVVEAIQSERALVLLSFLADQGIIARVLEEKKMGYCVPRSQLDGSFTRDSVAESLKLVMVEEEGKIYRERIREMKDLFVNKERDEKLMDGFLSYLKKHRNVDDEDH

SEQ ID NO: 1100 - protein, 456 aa, Juglans regia
MDTARKRIRVVMLPWLAHGHISPFLELSKKLAKRNFHIYFCSTPVNLSSIKPKLSGKYSRSIQLVELHLPSLPELPPQYHTTKGLPPHLNATLKRAFDMAGPHFSNILKTLSPDLLIYDFLQPWAPAIAASQNIPAINFLSTGAAMTSFVLHAMKKPGDEFPFPEIHLDECMKTRFVDLPEDHSPSDDHNHISDKDRALKCFEQSSGFVMMKTFEELEGKYINFLSHLMQKKIVPVGPLVQNPARGDHEKAKTLEWLDKRKQSSAVFVSFGTEYFLSKEEMEEIAYGLELSNVNFIWVVRFPEGEKVKLDEALPEGFLQRVGEKGMVVEGWAPQAKILMHPSIGGFVSHCGWSSVMESIDFGVPIVAIPMQLDQPVNAKVVEQAGVGVEVKRDRDGKLEREEVATVIREVVMGNIGESVRKKEREMRDNIRKKGEEKMDGVAQELVQLYGNGIKNV

SEQ ID NO: 1101 - protein, 452 aa, Cephalotus follicularis
MDLKRRSIRVLMLPWLAHGHISPFLELAKKLTNRNFLIYFCSTPINLNSIKPKLSSKYSFSIQLVELHLPSLPELPPHYHTTNGLPLHLMNTLKTAFDMASPSFLNILKTLKPDLLICDHLQPWAPSLASSLNIPAIIFPTNSAIMMAFSLHHAKNPGEEFPFPSININDDMVKSINFLHSASNGLTDMDRVLQCLERSSNTMLLKTFRQLEAKYVDYSSALLKKKIVLAGPLVQVPDNEDEKIEIIKWLDSRGQSSTVFVSFGSEYFLSKEEREDIAHGLELSKVNFIWVVRFPVGEKVKLEEALPNGFAERIGERGLVVEGWAPQAMILSHSSIGGFVSHCGWSSMMESMKFGVPIIAMPMHIDQPLNARLVEDVGVGLEIKRNKDGRFEREELARVIKEVLVYKNGDAVRSKAREMSEHIKKNGDQEIDGVADALVKLCEMKTNSLNQD

SEQ ID NO: 1102 - protein, 459 aa, Prunus avium
MVYSQQRSITILMLPWLAHGHISPFLELAKKLTSKRNFHIFICSTPVNLTSIKPKLSPKYSHCIEFVELHLPHEELPELPPHYHTTNGLPPHLMSTLKRAFDMSSNNFSTILTTLKPDLLIYDFLQPWAPSLASLQNIPSVEFITTSAAMTSFGVHHLKNPSAKFPFPSINLRDYEAQKFNNLLESSSNGIKDGDRIQQCSDLSSDIILVKTSREIEAKYVDYLSGVMGKKIVPVGPLVQEPMDLKVDEETWIMKWLNKRERASVVYVGFGSEYFLTKEEIEEIAHGLELSKASFIWVIRFPKEEKGRRVEEVLPEGFLERVGEKGIIVEGWAPQAKILKHSSVGGFVSHCGWSSVLESIKFGVPIIAMPMHLDQPINSRLVEEAGVGVEVKRTAEGSRQREEVAKVIRDVVVEKIGEGVRKKALEIRDNMKKKEDAEIDGVVEELMQLCTKRGSNVNF

SEQ ID NO: 1103 - protein, 439 aa, Quercus suber
MEATHNTISVLMLPWLAHGHISPFLELAKKLTTRNIHIYFCTTPINLGPIKQQQLSEKDSLSIELVELHLPSLPELPPHYHTTNGLPPHLMPTLKKAMDMASPNITNILTQLKPDLVIYDFLQILAPSLAQSQNIPAVNFVVMSATIVSFYMHFANNPGVEYPSPEIYLQDHEVGKFANDTDDGDRILECFQQSSEIVLIKTFQEIEAKHIDYLSVLAKKKIVPVGPLVQDPVEEDEKKGIIEWLNDKEPSSAVFVSFGSEYFLSKEETEEIAYGLELSMVPFIWVVRFPRGEKVNLQMALPKGFLDRVGDRGMVIEGWAPQKTILKHSSIGGFVSHCGWSSVMESMKFGVPIIAMPMHLDQPVNARLVEAIGAGVEVKRDKKGRLEREEVAKVIRKVLVENTTKRKAKELKENIENKGDEEIVGVVQELLRLCSKLKE

SEQ ID NO: 1104 - protein, 448 aa, Citrus sinensis
  misc_feature (341)..(341): Xaa can be any naturally occurring amino acid
MNNRQRNYCVLMFPWLAHGHVFPFLELTKKFTKRSNFYIYFCSTPAILDSIKLSDNFSLSIQLIELHLPSLPELPPHYHTTKGLPLHLMPTLKKAFDMASSSFFNILKNVNPDLLIYDFIQPWAPTLALSLNIPSVLFLTSSATMGGFLFHTFEKTPSEDDGEFPFSSIFIHEYMKPKFSHLVDSSSNGIKDKDKFLQCCDSSCNVILIKTFRDLQGKYIDYLSVLMKKKLVPVGPLVEDPVEEDDHEEGIEIIQWLDKKERSSTVFVSFGSEYFLPKEEMEGIALGLEFSGVDFIWVVRFPSGVKVKVDEELPKHFLERTKERAMVVEGWAPQMKILGHXGGFVSHCGWSSVMESMKLGVPIIAMPMHLDQPLNARLVEDVGVGMEVRRNENGRIEREEMARVIKEVVVEKNGEKLRRKAREMSENIRKKGDEEIDEVVDELSQLSG

SEQ ID NO: 1105 - protein, 501 aa, Lagenaria siceraria
MASHDHGTPHFLLFPFMAQGHMIPMIDLAKLLASRGAIITIVTTPLNSARFHSVLTRAIHSGLQIHVLELQFPTCQETGLPQGCENVDLLPSLASLSQFYRAASLLYGPSEKLFQQLNPRPNCIISDMCLPWTFQLAQKFHVPRLVFYSLSCFFLLCMRSLIANIDFLKPIPDSEFVALPDLPFPVEFRRSQLYKSTDDYLTQFSLAMWEADRQSYGVVLNVFEEMEPEHVTEYIKGRESPEKVWCIGPLSLSNDNELDKAERGDKSSIDGHECMKWLDGQNPSSVVYVSLGSLCNLGTSQIIELGLGLEASKKPFIWVIRKANLTANLLKWVEEYDFEEKTKGRGVVIRGWAPQVLILSHSSIGCFLTHCGWNSSIEGISAGVPMITWPLFADQVFNYKLIVEILKVGVSVGEETETNWEKEEGEGERVVVKKEKVREAIEMVMDGDEREEMRKRCKEIGEKAKRAVKEGGSSHRNLSRLIEDISAHVFVHGESFENGRS

SEQ ID NO: 1106 - protein, 483 aa, Cucumis sativus
MASPPHFLLFPFMAQGHVIPMIDLAKLLAHRGVIITIVVTPTNAARNHSVLDRAIRSGLQIRMIQLPFPSKEGGLPEGCDNLDLLPSFKFASKFFRATSFLYQPSEDLFHQLKPRPICIISDTYLPWTFQLSQKFQVPRLVYSTFSCFCFLCIHCLMTNPALSISDSDSVIFSDFTDPVEFRKSELPKSTDEDILKFTSEIIQTDAQSYGVIFNTFVEMEYNYITDYRKTRQKSPEKVWCVGPVSLYNDDKLDLLERGGKASINQQECINWLDEQQPSSVIYVSLGSLCNLVTAQLIELGLGLEASNKPFIWSIREANLTEELMKWLEEYDLEGKTKGKGLVICGWAPQVLILTHSAIGCFLTHCGWNSSIEGISAGVPMITWPLFGDQIFNYKLIVDVLKVGVSVGVETLVNWGEEDEKGVYVKREMVREAIEMVLEGEKREEMRERSKKLAEIAKRGMEEGGSSYKDITMVIEDIIGNGGC

SEQ ID NO: 1107 - protein, 488 aa, Cucumis sativus
MASPHFLLFPFMAQGHMPPMIDLAKLLARRGVIITIVTTPHNAARNHSILSRAIHSGLQINVVQLPFPCLQGGLPEGCENLDLLPSLDLASKFLRATFFLLDPSAELFQKLTPRPTCIISDPCLPWTIKLAHKFHIPRIVFYSLCCFSLLCQPTLVNKEPLLRSLPDQALVTVPDLPGYDFQFRRSMLPKHTDQYFAAFNREMEEADLKSYSIIINTFEELEPKNLAEYRKLRDLPEKVWCIGPVSLCNHDKLDKAERGNKSAIDQHECLKWMDWQPPSSVVYVSLGSICNITTRQLIELGLGLEASKRPFIWVIRKGNETKELQKWMEAYNFKEKTKGRGLVIRGWAPQVMILSHTAIGSFLTHCGWNSTLEGISAGVPMITWPLFSDQFNNEVLIVKMLKNGVSVGVEASLQWGEEEEIEVAVKKEDVMNAIERVMSGTKEGEEIRERCKELGKKANRAVEEGGSSHHNIKLFIDDLIDLAGGDPN

SEQ ID NO: 1108 - protein, 494 aa, Cucurbita maxima
MASKSKQPPHFLLIPLMAQGHLIPMADLAKLLAENGARVSLITTPQNASRINSLLSHPNQSQIQILHLQFPSHQQSGFPQGCENFDSLPSLSLLPKFLSATALFCRATEDLFQQLSPRPSCVVSDMALPWTIKVAHKFNVPRLVFYSLSSLYLLGMANLRATGVIDKIMSASDSERIVIPNLPDKVELTKPQFICTLDAGFMEWANEMGKADQASYGVIVNSFDGLEPKYLEELKKAIGSEKVWCVGPVSLCNKDTTDKAIRGNKAALDEHECLKWLDRQQPGSVVYAALGSLCNLIAAQIIELGLALEALNRPFIWVIRQTEATNNELEKWLSESGFEERTKERGLVVRGWAPQLLILSHPAAGAFVTHCGWNSTIEGITAGVPMVAWPLFADQIFNEKLIVQLLKVGVSVGMEKSVMWGSEEEIGVQVKMEGIRGAIEKVMDGDGNKEMRRRVRDLAERAKAAMEEGGSSHLNLKLLIEDIMHEAEARESHK

SEQ ID NO: 1109 - protein, 493 aa, Cucurbita moschata
MFLILFSAYIASSFVNRLRTFNSVYMATPHFLLFPFMAQGHMIPMVDLAKLLAHRGAIVTIVLTPNNAARNHSVLSRAIDSGLQIRVVQLEFPWKEGGLPEGCDNVDLLPSLTSMSTFFKAASLLYDPSEKLFLQLHPRPASIISDMNLPWTLQLAQKFHVPRLVFYSYSAYFLHCLQGLMTHRDPVEFHKSELPRATDADLAKFGVEMMLADAQSYGVVFNSFEEMEPKYVAECRKTRESPEKVWCVGPVSLCNNDKLDKAERGNKASIDQHQCIEWLDGQQPTSVVYVSLGSICNLVTAQLIELGLGLEASNKPFIWVIRKANLTEELLKWLEEYDLEGKTKGRSLVIRGWAPQVLILSHPSIGCFLTHCGWNSSIEGISAGVPMITWPLFADQVFNYKLIVEVLKVGVGMGVETVMHWGEEEEIGVVVKREKVREAIEMVFDGEDREEMRQRSKKLAVMAKRAVEEGGSSHRDIKLLIEDTVAHGGDHEI

SEQ ID NO: 1110 - protein, 495 aa, Cucurbita pepo
MGSETNSGEYHILMLPFMAHGHLIPFLELANFIHRKSSVFTITIACTPSNIQYLRSAAADSKIRLAELYYSSSDHGLPPNTESTENLPLNQIDTLFHSSTALELPLRELISDLVQKEGNPPQCIISDVFLGWSVAVARSFNIPVFSFTTCGAYGTLAYISLWLNLPHRSSTSDEFSLPGFPESCRFHRSQLHRFLLAADGTDSWSRYFRPQISYSLSSDGWLCNTVEEVESFGLKHLRDYIKLPVWAIGPLLLQTSSGGRRRWGKEKDSGVGLEACMNWLNSHRKNSVLYISFGSQNTITETQMMELAYGLEESGSAFIWVVRPPSGHDMKAEFRAHQWLPEHFEDRMKETNRGLVIRNWAPQLEILAHESVGAFLSHCGWNSTVESLSQGVPVIGWPMAAEQAYNSKMLVEEMGIGVELTRGKESEIKRGRVKEVIEMVMGECGEGEEMRNKAAIVKDKMRAAVMDEQKGSSNTNLVDFLEFIQAKQKSLNKIK

SEQ ID NO: 1111 - protein, 497 aa, Cucumis melo
MDSHTHGTPHFLLFPFMAQGHMIPMIDLAKLLACRGAIITIVTTPLNSARFHSVLTRAIDSGHQIHVHELQFPSHQETGLPEGCENVDLLPSLASLSQFYQAISLLHQPSEKLFEQLTPRPNCIISDMCIPWTFEISQKFHVPRLVFYSLSCFFLLCMRSLTTNFEFLKSMPDSEFLTLPGLPSHVKFRRSKIFTSTDDYLIQFSLRMWEADRQSYGVIVNVFEEMEPEHVTEYIKGRESPEKVWCVGPLSLSNDNELDKAERGNKAIIDGHECIKWMDEQKPSSVVYVSLGSLCNLCTEQIKELGLGLEASNKPFIWVIRKANLTEELLKWMDEYEFEEKTKGRGLVIRGWAPQVLILSHSAIGCFLTHCGWNSSVEGISAGVPMITWPLFADQLYNHKFIVEILKVGVSVGEETEGDLGGVGKVVVKREKVKEAIEMVMDGDDSEEMRKRCKEYSEKAKKAVEEGGSSHRNLNRLVEDITAHAFAYGNENGNGSC

SEQ ID NO: 1112 - protein, 477 aa, Cucumis melo
MASTPHFLLFPFMEQGHMIPMIDLAKLLALHGAIITIFTTPINAARYHSVLSRAIHSGSQIHVVQVPFPGNKVGLPEGCESAELLPSFRSMFTFFRATYLLYDPADELLQQLRPRPTAIISDCCHPWTLRLAHKHNIPRLVFYSLNCFFFLCQQDLGTKETLIRSISDYEFVTLVEEFKFRKAQLPKFNDDFVAFMKESNEADMMSDGVILNVFEELEPKYNAEYKKIFGSPDRVWCVGPLSLCNESKLDRAERGDKASIDEHECTKWLDEQEPCSVVYVSLGSACNLVTAQHIELGLGLEALNKPFIWVIRKGNLTEELLKWLEEYDFEEKIKGRGFLIRGWAPQVLILSHSSIGSFLTHCGWNSSIEGIAAGVPMITWPLFGDQIYNQTLIVEILKIGASVGVEMGMPWGEEEEKGVVVKREKVKEAIEMVMEGENRAEMKQRCKELAEMAKRAVEEGGSSHRNLRLLIQKHQQL

SEQ ID NO: 1113 - protein, 476 aa, Citrullus lanatus
MAQGHMIPMIDLAKLLAHHGSIITIVTTPHNAARYHSVLARATDSGLQIHMVLLQFPSTQVGLPEGCENLDLLPSPLSSSVAAFYRATCLLYEPSEKLFHQLSPPPTCIISDMCLPWTLRLAQNHQIPRLVFYSLSSFFLLCMRSLKINHDLVTSISDSEFLTLSDLPDPVEFRKSQLPTVKIQEMEKLGYEMVEADRQSHGVILNVFEEMEAEYVAEYRKNRESPEKVWCVGPVSLCNDNTLDKAERGEKSSINGDKCIKWLDEQQPCSVVYVSMGSLCNLRTPQLIELGLGLEASKKPFIWVIRKGNLTEDLQRWVVEYDFEGKIEGRGLVIRGWAPQVAILSHSAIGSFLTHCGWNSSIEGISAGVPMITWPLFADQVFNAKLIVEVLKVGVSVGEETALYWGGEEENGVMVKREEVRRAIEMVMDGEDREEMRQRSKEFAEMAKRAVEEGGSSHRNLKLLIEEIMYENGSCR

SEQ ID NO: 1114 - protein, 492 aa, Citrus sinensis
MDTQANQLHFVLFPFLAQGHMIPMIDIARLLAQRGVIITIVTTPVNAARFNGILARAIESGLQIKIVQFQLPCEEAGLPEGCENLDMVASLGLAFDFFTAADMLQEPVENFFAQLKPRPNCIISDMCLPYTAHIAGKFNIPRITFHGTCCFCLVCYNNLFTSKVFESVSSESEYFVVPCLPDKIEFTTQQVDSSLGSRFNVFQKKMGAADTGTYGVIVNSFEELEPAYIKEYKKIRHDKVWCIGPVSLGNKEYSDKAQRGNKASVDEHQCLKWLDSKAPKSVVYACLGSLCNLIPSQMRELGLGLEASNRPFIWVIREGETSKELKKWVVEDGFEERIKGRGLVIWGWAPQVLILSHPSIGGFLTHCGWNSTIEGVSAGLPLLTWPLFGDQFMNEKLVVQILKIGVKVGVESPMIWGEEQKNGVLMKRDDVRNAVEKLMDEGKEGEERRNRAVKLGQMANMAVQEGGSSHLNITLVIQDIMKHVHSTSQANK

SEQ ID NO: 1115 - protein, 489 aa, Momordica charantia
  misc_feature (338)..(338): Xaa can be any naturally occurring amino acid
MASPHFLIFPFMAQGHMIPMMDLANLLAHQGAIVTIVTTPHNAARYHSVLTRAIGSGSQIRVVQLEFPCHEAGLPHGCENLDLLPSLSSMSTFMKATYLLHDPSEKLLPQLSPRPTCIISDMCLPWTLTLAHKFRVPRLVLYSLSCFFLLCMHSVKYHIPSFSSISDSELVDFSGLPHPVQFRKSQLPKATDEAMSKFGYEMGEADRQSHGVIINTFEEMEPEYLAEYRKLRELPEKVWCVGPLLLYNDNKLDVAQRGNTAAIDENECINWLDGQRPCSVVYVSLGSLCNLTTPQLIELGLGLEASNKPFIWVIRKLNLTKELLDWMEEYDFEGRTKXRGLVIRGWAPQVMILSHSSTGCFLTHCGWNSSIEGMSAGVPMITWPLFADQVFNEKLLVEIVRIGVSVGAETAVPWGEEEKIGVLVKRESVREAIEMAMDGDGSEEMRQRCKQLAEKAKRAVQEGGSSHRNLKLLIEEIVDDGRSCENGSC

SEQ ID NO: 1116 - protein, 494 aa, Cucurbita pepo
  subsp. Pepo, vegetable marrow
MAPHSDTLHFLLFPFMAQGHMIPMMDLAKLLARNGAIVTIVTTPLNFARYHSVLTRAIDSGLQIHVVQLQFPWTKNSGIPEGCENVDLLPSLSYLSHFYRVLSLLYDPSEKLFEQLTPRPNCIISDMCIPWTFQLAQKFHVPRLVFYSLSCFFLLCLNRLFGKSDVWKSLSDSEFVAVPDFPDPVEFLKSHLPRGTDDYATQFGQAMKEADRQSYGVILNVFEEMEPEYLTEYKKGRELPENVWCVGPLSLSNDNELDKAERGNKASINEHECIKWLNGQQPSSVVHASLGSLCNLGTEQLIELGLGLEASNKPFIWVIRKANLKEELLKWLEEYDFERKVSGRGLVIRGWAPQVLILSHSAIGCFLTHCGWNSSIEGISAGVPMITWPLFADQIFNEKLIVQILKVGVSVGEETVVHFDREDEELVLVKREKVREAIETVMDGDEREAMRERSKKLANKAKTAMEEGGSSHRNLKMLIQDLIAHGRSSKNGSC

SEQ ID NO: 1117 - protein, 481 aa, Cucurbita pepo
MTDSQEAPCHVFLVCYPGQGHINPTLRLAKKLAAEGLLVTISTAVHFGKTLQKAGSIGAGDCPTPVGNGFIRFEFFEDGLQELNPKDVNLERVVYQIELFGRPSLAGLIKNQTAENRSVSCLIVNPFLPWTCEVAKELEIPCAILWVQSCAVFSIYYHCYHKSVPFPSELEPKIDVHLPILPLLKNDEIPSFLHPNNIYGVLGNVLLSQFSKLSTPFCILMDTFDELEKDIINYMSNIIPLKPIGPLFLNSQNVETEVSVDCLKAEDCMEWLNSKPTQSVVYVSFGSIVHLKQEQINELAYGLCNSGFSFLWVMKPPDDVYGLKGHVLPEGVMEKAGERGKVVQWSSQERVLSHESVGCFMTHCGWNSSVEAIGCGVPVVAFPQWGDQVTNAKFLVEDYGVGVRLSRGAEANELISRDEIVRCISEVMTRDSSGGEFRRNALKLKQAAAAAVVDGGSSHHNIQEFVDEIKKRRMNMCSECS

SEQ ID NO: 1118 - protein, 451 aa, Cucurbita pepo
MKHVSNKPRVLFVPYPAQGHVTPMLMLAAVFQRRGFLPIFLTPSYIHRHISSQISLTNEILFISMPDTVDDNTPHDFFTIETALETTMPSYVRRVLGEYNSNESGVVCMVVDLLASSAIEVGKEYGVAVAGFWPAMFATYNLISAVPDMVKNNLISSDTGCPGEGSKRCVPNQPLLSTEELPWLIGTSSARKARFKFWTRTMVRAKSLQWILVNSFPEELPLENPIPKSSAAVFLVGPLSRHSNPAKTPTFWEEDDGCLQWLEKQSPNSVVYISFGSWVSPINESKVRSLAVALLGLRKPFIWVLKSNWRDGLPIGFTQKIQRYGRLVSWAPQMEILKHRAVGCYLTHCGWNSIMEAIQCRKRLLCFPVAGDQFLNCGYVVKVWRIGLKLNGFGEKEVEEGVRKVMEDGEMKARMMKLHERIMGEDANSRVNSSFTTFIKDINKLSFDKFL

SEQ ID NO: 1119 - protein, 476 aa, Cucumis sativus
MKGEPQAPHVLIFPLPFQGHINSMLKLAELLSIAGITVTFLNTPHFQSQLTRHSDVLSRFSRFPTFRFHTIIDGLPPDHPRTIEFFAQIISSLDSITKPIFRNWLVSGHFGSNLTCVVLDGFLKNFIDGDEDEVKQPIFGFRTVSACSVWTYLCAPHLIEDGQLPIRGEEDMDRMITNLPGMENLLRCRDLPGLCRVTDTNDSVLQYTLKQTQGSYQFHALILNSFEDLEGPILSKIRTNLCPNLYTIGPLHSLLKTKLSHETESLNNLWEVDRTCLAWLDNQPPGSVIYVSFGSITVMGNEGLMEFWHGLVNSGRNFLWVIRPDLVSGKNGEIEIPADLEEGTKQRGYVVGWAPQEKVLSHEAVGGFLTHSGWNSTLESIVAGKAMVCWPYTADQQVNSRFVSNVWKLGVDMKDMCDREIVAKMVNEVMVNRKEEFKRSAIEMANLARRSVSLGGSSYADFDRLVNEIRLLSLRQ

SEQ ID NO: 1120 - protein, 478 aa, Lagenaria siceraria
MAKPRVLLFPFPALGHVKPFLSLAELLSDAGLDVVFLNSEYNHRRISNVIESLSSRFPSLRFETIPDGLPPDQPRSLVDSPLYFTMRDGTKARFRQLIQSFNDGCSANPWPITCIINDVMLSSPIEVAEEFGIPVISFCPHSARYFYTHFLVPKLVEEGQIPYTDENPFGKIEGIPLFEGHLRRNHLPGSWSQQSSHISFSHSLINQTVAAARSSALILNTFHDLEAPFLTHLSSIFNRIYTIGPLHALFKSKLSNSSSLPPTLVGFQKEDESCISWLDSQPPESVIFVSFGSSMKMEARELTEFWHGLVNSGFRFLCVLRSDGVYGGESAELIEQVVGKKGYDRNVVVVEWADQEKVLSHPAIGGFLTHCGWNSTLESIVAGVPMIGWPILGDQPSNAAWIDKVWKIGIERNDEKNWDRSTVKMMVRELMDSQKGVEIRRSVKKLSKLTKENVGKGGLSFDNLEYLVQHIKNLKPYI

SEQ ID NO: 1121 - protein, 494 aa, Cucumis melo
MGSLSKVDQENQQPHAVFVPYPSQGHISPMLKLAKLFHHKGFHVTFVNTEYNHRRLLRSRGPNSLDGLPDFQFRAIPDGLPPSDGNATQHVPSLCYSTSRNCLAPLCSLISEINSSGSTVPPVSCIIGDGVMTFTVFAAQKFGIPIASFWTASACGCLGYMQYAKLVEQQMIPFKDENFMSNGDLEETIEWIPPMEKIRLRDIPSFIRTTDKDDIMLNFFIQQLETLPKANAIIINTFDSLEHHVLEALSSKLPPIYPIGPINSLVTELIKDDKVKGIRSNLWDEQSECMKWLDSQQPNSVVYVNFGSITVMSPQHLVEFAWGLANSEKPFLWIVRPDLVEGETALLPAEFVAETKERGMLGDWCNQEEVLKHPSVGGFLTHSGWNSTMESIAGGVAMISWPFFAEQQTNCRYCKTEWGNGLEIDSNVRREDVEKLVRELMEGEKGEDMKRNAKEWKRKAEEACKIGGSSLTNLDQVISEILLSKDKSNLKSQN

SEQ ID NO: 1122 - protein, 473 aa, Citrullus lanatus
MDSHTRTHHHVLLFPFPANGHIKPFLCLAHLLCNAGLRVTFLNTHHHHRNITHNLTRLAAQFPSLHFESISDGLPLDQPRNIVDGKLFESMPRVTKHLFRQLLLSYNNGTSPITCVITDVILRFPMDVAQELRIPVFCFATFNARFLFLFFSIPKLIEDGQIPYPVGNSNQELHGVPGGEGLLRCKDLPGFWSVEDVAKMDPMNFVSQILATSKSSGLILNTFDELEAPFVTSLSKIYKRLYTIGPIHSLLKNSTQSQCEFWKEDHSCLAWLDSQPPRSVLFVSFGSLVKLTSSQLKEFWNGLVNSGKAFVLVLRSDGLIEEAGEDGKQKKLVIKEIMDTKAEGRWMIVNWAPQEQVLVHEAIGGFLTHSGWNSTLESLTAGVPMISWPQIGDQTSNATWITKVWKIGVQMEGSYDRSTVETMVKSIMEQQDEKMENTIAELAKRAKDRVSKHGTSYQNLQRLVEDIQEIKLN

SEQ ID NO: 1123 - protein, 477 aa, Citrus sinensis
MEQTRVPHVVLLPFPAYGHIKPMLSLAKLFSHAGFRITFVNTDQYHDRLFGNTDVTAFYKHFPNFLCTSIPDGLPPDNPRFGIYTKDWFCSNKPVSKLAFRQLLMTPGRLPTCIISDSIMSFAIDVAEELNIPIITFRPYSAYCSWSDFHFSKLAEEGELPVTDENFDKPVTCIPELENIFRNRDLPSICRHGGPDDPILQTFIRDTSATTRTSALVINTFNEIEGPIISKLGSRLTKIYTVGPLHALLKSRIQEDSVESSPLESNNCVLSKEDRSCMTWLGSQPSRSVLYVSFGSFIKLSGDQILEFWHGIVNSGKGFLWVIRSDLIDGESGVGPVPAELDQGTKERGCIVSWAPQEEVLAHQAIGGFLTHSGWNSTLESMVAGVPMICWPQVGDQQVNSRCVSEIWKIGFDMKDTCDRSTIEKLVRDLMDNKRDKIMESTVQIAKMARDAVKEGGSSYRNLEKLIEDIRLMAFKA

SEQ ID NO: 1124 - protein, 472 aa, Momordica charantia
MAQPQTQARVLVFPYPTVGHIKPFLSLAELLADGGLDVVFLSTEYNHRRIPNLEALASRFPTLHFDTIPDGLPIDKPRVIIGGELYTSMRDGVKQRLRQVLQSYNDGSSPITCVICDVMLSGPIEAAEELGIPVVTFCPYSARYLCAHFVMPKLIEEGQIPFTDGNLAGEIQGVPLFGGLLRRDHLPGFWFVKSLSDEVWSHAFLNQTLAVGRTSALIINTLDELEAPFLAHLSSTFDKIYPIGPLDALSKSRLGDSSSSSTVLTAFWKEDQACMSWLDSQPPKSVIFVSFGSTMRMTADKLVEFWHGLVNSGTRFLCVLRSDIVEGGGAADLIKQVGETGNGIVVEWAAQEKVLAHRAVGGFLTHCGWNSTMESIAAGVPMMCWQIYGDQMINATWIGKVWKIGIERDDKWDRSTVEKMIKELMEGEKGAEIQRSMEKFSKLANDKVVKGGTSFENLELIVEYLKKLKPSN

SEQ ID NO: 1125 - protein, 466 aa, Momordica charantia
MAQPRVLLFPFPAMGHVKPFLSLAELLSDAGVEVVFLSTEYNHRRIPDIGALAARFPTLHFETIPDGLPPDQPRVLADGHLYFSMLDGTKPRFRQLIQSLNGNPRPITCIINDVMLSSPIEVAEEFGIPVIAFCPCSARFLSVHFFMPNFIEEAQIPYTDENPMGKIEEATVFEGLLRRKDLPGLWCAKSSNISFSHRFINQTIAAGRASALILNTFDELESPFLNHLSSIFPKIYCIGPLNALSRSRLGKSSSSSSALAGFWKEDQAYMSWLESQPPRSVIFVSFGSTMKMEAWKLAEFWYGLVNSGSPFLFVFRPDCVINSGDAAEVMEGRGRGMVVEWASQEKVLAHPAVGGFLTHCGWNSTVESIVAGVPMMCCPIVADQLSNATWIHKVWKIGIEGDEKWDRSTVEMMIKELMESQKGTEIRTSIEMLSKLANEKVVKGGTSLNNFELLVEDIKTLRRPYT

SEQ ID NO: 1126 - protein, 462 aa, Cucurbita maxima
MELSHTHHVLLFPFPAKGHIKPFFSLAQLLCNAGLRVTFLNTDHHHRRIHDLNRLAAQLPTLHFDSVSDGLPPDEPRNVFDGKLYESIRQVTSSLFRELLVSYNNGTSSGRPPITCVITDVMFRFPIDIAEELGIPVFTFSTFSARFLFLIFWIPKLLEDGQLRYPEQELHGVPGAEGLIRWKDLPGFWSVEDVADWDPMNFVNQTLATSRSSGLILNTFDELEAPFLTSLSKIYKKIYSLGPINSLLKNFQSQPQYNLWKEDHSCMAWLDSQPRKSVVFVSFGSVVKLTSRQLMEFWNGLVNSGMPFLLVLRSDVIEAGEEVVREIMERKAEGRWVIVSWAPQEEVLAHDAVGGFLTHSGWNSTLESLAAGVPMISWPQIGDQTSNSTWISKVWRIGLQLEDGFDSSTIETMVRSIMDQTMEKTVAELAERAKNRASKNGTSYRNFQTLIQDITNIIETHI

SEQ ID NO: 1127 - protein, 472 aa, Rosa chinensis
MEMQMELRPQPHVLLLPFPAQGHIKPMLALAQLLCHAGIHVTFLNTEHNHRQLTQRQALSARFPTLHFRSISDGLPSDHPRSISPNLMDIVSSLRSKTAPLLHQLLVSLMSKNDVGSAAQLPSLGCVITDGIMCFAIEAAEEVGIPVIALRTTSACSFWCYSCIPKLIEEAQLPFGDEDMDKMVSGIPGMECLLRRRDLPSICRVPTDHPVIQFFVEETRAITRASSLILNTFDDLESSILSHIASRFSKIYTIGPLHALLKSRVVDDNLSSSLRQEDRGCMMWLDSQRVGSVIFVSFGSLVKLTRVQLLEFWHGLVNSGSPFLWVIRSDVLWSDEAEQASHVTPAEVIVDWAPQEEVLAHEAVGGFLTHSGWNSTLEAIWAGVPMLCWPQLADQQVNSRWVGEVWKIGVDMKDTCDRSTVEKMIKALMKGEDKEVISRSVDHFAKLARTSVSKNGSSYLNLEKLIQDLRNL

SEQ ID NO: 1128 - protein, 474 aa, Lagenaria siceraria
MDLSHSQTHHHVLLFPFPVKGHIKPFLCLAHLLCNAGLQVTFLNTHHHHRNIHNLTHLAAQFPSLHFQSISDGLLPDQPRNTVDGKLLESMPRVTKTLFRQLLLSYSNGTSPITCVITDVILHFSMDVAQELGIPVFCFSTFSACSLCLLFSIPKLLEDGQVPYPVENSNQELHGILGGEGIFRCKDLPGPWSVEDVVKNDPMKFVNQILATSKSCGIILNTFDELEALFVTCLSKIYNKVYTIGPIHSLLKNSTQTQYEFWKEDHSCLKWLDSQPPRSVVFVSFGSLVKLTSSQLKEFWNGLVNSGKAFMLVLRSDVLIEEAGEEEEKQKELVIREIMDTEGEGRWVIVNWAPQEEVLGHEAIGGFLTHSGWNSTLESLTAGVPMICWPQIEDQTCNATWITKVWKIGVEMEDSYDRSTVETMVRSIMEHQDEKMENNIAELAKRAKDHVSKHGTSYQNLQRLVEDIKEIKLN

SEQ ID NO: 1129 - protein, 483 aa, Lagenaria siceraria
MEEQQTSSPHVLLFPAPAQGHINVMLKLAELLSLSAIHVTFLTTEHSHRQLTLHSDVLHRFSRFPAFQFRTISDGLPFSHPRTFSHHLPEIVNSLISVTKPLFRDLLISGHYASDLTCLILDGFFSFLVDIDDDFVKLPIFCFRTFGACSSWAILSVPNLIKQGQLPIEGEEDMDRILDNVPAMENLLRCRDLPGFCRAADPNNDPILQFIVSMFIRCTKFDALIMNTFEDLEGPILSNIRTLCPKIYSIGPLHALLKTKLSHETESLNNLWEVDRSCLAWLDNKPPGSVIYVSFGSITVMGNRELMEFWHGLVNSGRNFLWAIRPDLMKGKDGEIEIPAELEEGTKQRGYMVGWVPQEKVLSHKAVGGFLTHSGWNSTLESIIEGKPMICWPYAFDQQVNSRFVSNVWKLGLDMKDLCDRETVAKMVNDVMVNRKDEFMRSAAEIGNLARRSVNPGGSSYVNFDCLIEDIRILSQQKMANNN

SEQ ID NO: 1130 - protein, 471 aa, Cucumis sativus
MGLSPTDHVLLFPFPAKGHIKPFFCLAHLLCNAGLRVTFLSTEHHHQKLHNLTHLAAQIPSLHFQSISDGLSLDHPRNLLDGQLFKSMPQVTKPLFRQLLLSYKDGTSPITCVITDLILRFPMDVAQELDIPVFCFSTFSARFLFLYFSIPKLLEDGQIPYPEGNSNQVLHGIPGAEGLLRCKDLPGYWSVEAVANYNPMNFVNQTIATSKSHGLILNTFDELEVPFITNLSKIYKKVYTIGPIHSLLKKSVQTQYEFWKEDHSCLAWLDSQPPRSVMFVSFGSIVKLKSSQLKEFWNGLVDSGKAFLLVLRSDALVEETGEEDEKQKELVIKEIMETKEEGRWVIVNWAPQEKVLEHKAIGGFLTHSGWNSTLESVAVGVPMVSWPQIGDQPSNATWLSKVWKIGVEMEDSYDRSTVESKVRSIMEHEDKKMENAIVELAKRVDDRVSKEGTSYQNLQRLIEDIEGFKLN

SEQ ID NO: 1131 - protein, 483 aa, Cucurbita maxima
MEQEGDVPHVLIFPFPAQGHVNSMLKLAELLSLSGLRITFLNIHRIHQKLTLHSDILSRFSRFPNFQFRTITDGLTPQNRTLGMFSDLIRRLNSVTKPLLTQMLLSGELGPNPTCIILDGLFNFIVDVDAQPKIPVFSFRTISACSFWAYSFVPMLIEDGQLPIKGEEDMDRMIDGVTGMENVLRCRDLPSFCRLKDPSDPTLQHGVTQTIQSLKAHSLIFNTFEDLEGPILSGLRRRCPNIYAIGPLHSLLKSRLSGEESPFGSESFNNLWEVDRSCLAWLDAQPSKSVIYVSFGSVVVMGDGQFREFWHGLVNSGRRFLWVVRPNSVAGEDGENGILEELEKGTKERGCMVEWAPQEEVLAHEAIGGFLTHCGWNSTLESIVAGVPMICWPQFADQQTNSRYVSEVWRIGVDMKDVCDRETVSQMVNDVMENRRNELMGSVIETAKLAKTSVEEGGSSFRDLERMINDIRLLCRQQREAIH

SEQ ID NO: 1132 - protein, 462 aa, Cucurbita moschata
MELSRTHHVLLFPFPAKGHIKPFFSLAQLLCNAGLHVTFLNTDHHHRRIHDLNRLAAQLPTLHFDSVSDGLPPDEPRDVPDRKLCESIRQVTSSLFRELLVSYNNGTSSGRPPITCVITDVMFRFPIDIAEELGIPVFTFSTFSARFLFLIFWIPKLLEDGQLRYPEQELHGVPGAEGLIRWKDLPGFWSVEDVADWDPMNFVNQTLATSRSSGLILNTFDELEAPFLTSLSKIYKKIYSLGPINSLLKNIQSQPQYNLWKEDHSCMAWLDSQPRKSVVFVSFGSVVKLTNRQLVEFWNGLVNSGKPFLLVLRSDVIEAGEEVVRENMERKAEGRWMIVSWAPQEEVLAHDAVGGFLTHSGWNSTLESLAAGVPMISWPQIGDQTSNSTWVSKVWRIGLQLEDGFDSSTIETMVRSVMDQTMEKTVAELAERAKNRASKNGTSYRNFQTLIQDITNIIETHI

SEQ ID NO: 1133 - protein, 527 aa, Cucurbita pepo
MELSHTHHVLLFPFPAKGHIKPFFSLAQLLCNAGLRVTFLNTDHHHRRIHDLNRLAAQLPTLHFDSVSDGLPPDEPRDVPDRKLCDSIRQVTSSLFRELLVSYNNGSSSGRPPITCVITDVMFRFPIDIAEELGIPVFTFSTFSARFLFLIFWIPKLLEHGQLQYPVTSSLFRDLLVSYNNGTSSGRPPITCVITDCMFRFPIDIAEELGIPVFTFSTFSARFLFLFFWIPKLLEDGQLRYPEQELHGVPGAEGLIRCKDLPGFLSDEDVAHWKPMNFVNQILATSRSSGLILNTFDELEAPFLTSLSKIYKKIYIHSLHINQTPPPTGDQLHSISSPGDFNRFYRRLLLRHLRNGDSQNPILHRRLDLLHFSILRQSESPQELPFAPFNAMPLLVLLLLFNASLSADLKHAAVLHLHFDFLLLQPRQIGLENVGLWGLFPIDLRASLAVVGAHMSDKKGSKRLLVPNTLGIKDILVFFILPLPSPTFFPCMAMASNTASSRSFSRLPSQWRQPSPGLEFGLSAPAQ

SEQ ID NO: 1134 - protein, 459 aa, Cucurbita pepo
MERKQKERKGHLVLVPCPLPSHMSPMLHLAKLLHSQGFSITIIHTQLNSPNESHYPEFSFESIGGSMLESYSVFDGDVMLFLSKLNMKCETPFHECLVNMQLRCQFNPISCIIYDAVMYFSAAVADDLKLFRIVLRTSSAANYIGLSILDESDFVSERRMEEPVAGFPFLRIKDMPLFSTQKHTREVLTCIYNGTRTASAIIWNSLWCLEHALFEKIKNETLVPVFPLGPLQKHCSSFSTNALNEEQGCIAWLDKQAPSSVVYVSIGSVVTMTEDELLEMAWGLANSGRPFLWVVRACVVNGSDGVEMLPREFHEATRSRCRIASWLPQQKVLAHTSIGCFLTHNGWNSTIESIAEGVPMLCWPRVGDQRVNARFVSHVWRVGLQLEDRLLREDVESAIRTLFIDEEGIEIHKRAKELKKKVDISLRQGGASSEFLSRLVKYISLRRDNDKVVKCLISL

SEQ ID NO: 1135 - protein, 487 aa, Cucumis melo
MGSISISEQQPHAVCIPYPAQGHINPMLKLAKLLHSFGFHITFVNTDFNHRRLLKSRGPKALDGLSSFRFESIPDGLPPTDVDATQDIPSLCQSTRQFCLQPFKELVSKLNCDPNVPQVSCIVSDGVMSFTIDAADELGVPVVLFWTTSACGFLGYLHYQQLVERGYTPFKDESYLSNKQYLDTKIDWIPGMKDVRIRDIPTFIRTTDPKDVMVDFILGETKRAKRANAIVLNTVDSLEQEALNAMPSLLPPPVFSIGPLQLLLKQVASHDSDSLKSLGSNLWKEDTSCLQWLDQMSANSVVYVNFGSITVMTKDQLKEFAWGLANSGQTFLWIIRPDLVAGDTAVLPPEFIDMTKERGMLTNWCPQEEVLQHPAIGGFLTHNGWNSTFESIVAGVPMICWPFFAEQQTNCRYCCTEWGIGMEIDSDVKREEIEKQVRELMEGDKGKEMRKRAQEWKKLMADAAEPHSGSSFRNLNHLVHKVLLQSP

SEQ ID NO: 1136 - protein, 481 aa, Citrullus lanatus
MEKGVEPHVLMFPFPALGHVNPMLKLAELLSLSGLRITFLNIHSIHQRLILHTNLQSRFSCFPKFRFQTITDGLPPSYTGGLTKLSHLVRSMETVTKPLLKQMLLSGELGPIPTCIILDGFFSFMVDSTLSLEFPFSVSAPACSFWAYFSIPELIQEGQLPVKGEEDMDRMIEGVAGLENILRCRDLPSFSRVGDQTEPILQYSVAQTIESSKAHALILNTFEDLEGPILSCIRRRCPNIYAIGPLHAHLKSRHPGEKSPPELESSNGNWEVDRSCLAWLDAQPSKSVVYVSFGSVTVMGDNQFREFWHGLVDSGRRFLWVVRPNMVSGKDGENGVPAELEEGTKERGCMVGWAPQEEVLAHEAIGGFLTHSGWNSTLEGIVAGVPMICWPQFADQLTNSRFVSEVWKIGLDMKDVCDRKTVAKMVNDVMENRRNELMGSVIETAKLAISSVEEGGSSYCDLKRMIHDIQLLCRRRGEAID

SEQ ID NO: 1137 - protein, 482 aa, Momordica charantia
MEQSDSNSDDHQHHVLLFPFPAKGHIKPFLCLAQLLCGAGLQVTFLNTDHNHRRIDDRHRRLLATQFPMLHFKSISDGLPPDHPRDLLDGKLIASMRRVTESLFRQLLLSYNGYGNGTNNVSNSGRRPPISCVITDVIFSFPVEVAEELGIPVFSFATFSARFLFLYFWIPKLIQEGQLPFPDGKTNQELYGVPGAEGIIRCKDLPGSWSVEAVAKNDPMNFVKQTLASSRSSGLILNTFEDLEAPFVTHLSNTFDKIYTIGPIHSLLGTSHCGLWKEDYACLAWLDARPRKSVVFVSFGSLVKTTSRELMELWHGLVSSGKSFLLVLRSDVVEGEDEEQVVKEILESNGEGKWLVVGWAPQEEVLAHEAIGGFLTHSGWNSTMESIAAGVPMVCWPKIGDQPSNCTWVSRVWKVGLEMEERYDRSTVARMARSMMEQEGKEMERRIAELAKRVKYRVGKDGESYRNLESLIRDIKITKSSN

SEQ ID NO: 1138 - protein, 478 aa, Quercus suber
MEQHKVPHVVILPLPLSGHVKPMLILAELLCDAGFLITFVNSDYNHDRLERVMDIPAFYNRSPGFRFVSISDGLPLDQPRLGPIIFQLFFNTRTVSKPLFRELLISLRQSTERSPPTCIIADGLMCFAIDVAEELGVPIITFPTHGYHGMWTIMHTSNLIEEGEVPFQEESDMDKPVTSIPGMESLLRRRDLPGNCRLEVENPLMEFIISEASAMKRASTLILNTFEELEAPIIAHLGSFFDKVYTIGPLHALLKTRIKDSSQAVSSYGSLRKEDSSCVEWLNSQPLKSVIYVSFGSVVELSLDQLIELWHGLVNSRKPFLWVVRPDLVEGNEELGQISEELEQGTKEKGCMVSWAPQEEVLAHPSVGGFLTHSGWNSTLESIFEGVPMICWPQVADQQVNGRSVSKLWRVGFDMKDTCDRFIIEKIVRDLMEDKREEIIRSTNEIARMARGSVKENGSSHCNLERLIEDLRLMSLTN

SEQ ID NO: 1139 - protein, 444 aa, Citrullus lanatus
MDARQESFKVFMLPWLAHGHISPYLELAKRLAKRKFIVYFCSTPVNLEAIKSNYLSKSYSDSIQLVKIHLQSTPELPPHYHTAKGLPPHLMPKLKDAFQMAAPNLESILKTLNPDLLIVDILQLWMLPISSSLNIPMIFFPIFGAITISFLIRIVSNDVRFPEFELRDYWQSKCPYLQMDETSRQTFKQNLDQSSGIILFKSSREIETKYLEFLASSFTNKIVTTGPLLQEPACSEKEKHYEIIEWLDKKELYSTVLVSFGSEYYLSKEEIEEIAHGLEISEANFIWIVRFPNGDETAVEAAVPEGFIERSRERGKIVKGWAPQTEILAHRSTGGHMSHCGWSSFMESLMYGVPVIGAPMQLDGPIVARLAEEIGVGLEIKRDEEGRMMRDEIAGAIKKVLMEKPGEVFRKKAKEISSVLKEKDDEELDRLTTELVRLCETKRT

SEQ ID NO: 1140 - protein, 444 aa, Citrullus lanatus
MEGSESRKKVLLFPWLAFGHISPFLELAKKLSQNNFQIYLCSSPINLQSIHSKLPQSFCSSINLVELNLPSLPQLPPHMHSTNGLPLDLIPTLFKAFEMAAPEFSSILHRLNPDLLITDSFQPWAIQSASSLNIPVIPFSVVGAAVLAHSIHYILNPNIKFPFPEIDLMDHWISKRHPDIFKNPDVSMNLFLQWVENMKLCSDVVLANSFTEIEGKYLDYVSEMLKKKVVPVGPLIVTASDVANEKSDVLDWLDKKQPKSTVYVSFGSEYYLSKEDREELAHGLELSGANFIWVIRFPKGDEMGIEEALPEGFIERIGERGILVDGWAPQLKILKHSSIGGFVCHCGWNSVVEAVVHGVPIIALPMQLDQPFHARVATAAAGIGVEAERGVDGAVVRQGVAKAIKQVLFEKTGEDFKLKAKEICEILKDKGQNIKTCVAELHQL

SEQ ID NO: 1141 - protein, 452 aa, Cucurbita moschata
MDAQQAANKSPTASTIFMLPWVGYGHLSAYLELAKALSTRNFHVYFCSTPVSLASIKPRLIPSCSSIQFVELHLPSSDEFPPHLHTTNGLPAHLVPTIHQAFAAAAQTFEAFLQTLRPHLLIYDSLQPWAPRIASSLNIPAINFFTAGAFAVSHVLRAFHYPDSQFPSSDFVLHSRWKIKNTTAESPTQVKIPKIGEAIGYCLNASRGVILTNSFRELEGKYIDYLSVILKKRVLPIGPLVYQPNQDEEDEDYSRIKNWLDRKEASSTVLVSFGSEFFLSKEETEAIAHGLEQSEANFIWGIRFPKGAKKNAIEEALPEGFLERVGGRAMVVEEWVPQGKILKHGNIGGFVSHCGWNSAMESIMCGVPVIGIPMQVDQPFNAGILEEAGVGVEAKRDSDGKIQRDEVAKLIKEVVVERTREDIRNKLEEINEILRTRREEKLDELATEISLL

SEQ ID NO: 1142 - protein, 475 aa, Cucurbita moschata
MEGNRHGKTSVLMLPWLAHGHVSPFFELAKSLRRRNFHIYFCSTSVIINSIQSNLTRDLSSDIELVELKLPTSSDLPPYRHTTAGLPPHLMFSLKRAFDSAAATFSIILHNLNPDLVIYDFLQPWAPTVARSSHIPAVMFQPTGALMAAMVKYELEYPSSDLSSIFPDIRLTEYEIKQVKNLFRSSVNDARDEERIKECNERSCGMILVKSFREIEGKYIDFLSILLRKKVVPVGPLVQEPENDVVSRRRFEKWLNKKQDSSCLLVSFGSEFYLSKEDMEEIAYGLELSHVDFIWVVRFPVAGGGERKKNVEEELPKGFIERVRERGMVVEGWVPQAQILKHRTTGGFLSHCGWSSVMESIKFGVPIIAAPMQLDQPLNARLVEWLDVGVVIERDNGRLRRQEVARVVKEVMVEKMGERVRKKVKEFAEMLKKKGDEEMDMVVEELVKLCKSNKEDNLESHWCRPAIDSHFCEPR

SEQ ID NO: 1143 - protein, 448 aa, Cucurbita moschata
MEPKKPTKKILMFPWLAFGHISPFIQLAKHLSNTFEIHLCSSPVNLQSIQSKLPRTPSNPIHLLHLNLPPSPELPPHMHSTNGLPLRLIPTLLNAFDKAAPDFTSILHKLNPDLLITDMFQPWAVHSAAALNIPAVFFLVVGAGTFSHSVHSVLHHGVDFPFPELDLQNHWLFKRHQNDPSDSSVGVATSRFLQLVKDLEVYSDVVLVNSFMEIESKYIDYLSVLFKKKVVPVGPLVALSDEKSDVLDWLDQKEPKSTVYVSFGSEYYLSNEDRAELAMGLEMSGANFIWVIRFGKGESVGIREALPEGFIERVGERGLVVDGWAPQMGILKHTSIGGFVCHCGWNSVVEAAVNAVPIIALPMQLDQPFHGKVAVAAGVAVEAARGVDGAVQREGVAKAIKEVLFEKKGEELSGKAKEICESLKVKDGKNIDTCWSMHGSLEQVRSHT

SEQ ID NO: 1144 - protein, 457 aa, Cucurbita moschata
MDAQKAVDTPPTTVLMLPWIGYGHLSAYLELAKALSRRNFHVYFCSTPVNLDSIKPNLIPPPPSIQFVDLHLPSSPELPPHLHTTNGLPSHLKPTLHQAFSAAAQHFEAILQTLSPHLLIYDSLQPWAPRIASSLNIPAINFNTTAVSIIAHALHSVHYPDSKFPFSDFVLHDYWKAKYTTADGATSEKTRRGVEAFLYCLNASCDVVLVNSFRELEGEYMDYLSVLLKKKVVSVGPLVYEPSEGEEDEEYWRIKKWLDEKEALSTVLVSFGSEYFPPKEEMEEIAHGLEESEANFIWVVRFPKGEESSSRGIEEALPKGFVERAGERAMVVKKWAPQGKILKHGSIGGFVSHCGWNSVLESIRFGVPVIGAPMHLDQPYNAGLLEEAGIGVEAKRDADGKIQRDQVASLIKQVVVEKTREDIWKKVREMREVLRRRDDDDMMIDEMVAVISVVLKI

SEQ ID NO: 1145 - protein, 447 aa, Lagenaria siceraria
MDGQQGGSNTSTPTTILMFPWIGYGHLCAYLELAKALSRRNNFHIYFCSTPVCLDSIKPKLIPSSSIEFVEFHLFPSPELPPHLHTTNGVPPHIALTLHQAATAAAPRFESILQTLSPHLLIYDCFQPWAPRIASTLNIPAINFSTTGASIVSHEFHSIHYPDSKFPFSNFVLHNYWKAKLKSVTSEGACIIEGFFNCFNASCDVILMNSFREIEGEYMNYVSLLTKKKVIPVGPLVYEPNEEEEDENYSRIKNWLDKKETLSTVLVSLGSERTASEEEINEIGKGLEESEVNFIWVERSNSKGDEEQKRREFVEMVGERVMVVKGWAPQGKILKHGSIGGFVSHCGWNSVLESITFGVPIIGVPIFGDQPFNAIVVEEAGLGVEAKRDSDGKIQRKEIARLIKEVVVEKTREEIRMKVREMSEILRRKGDDKIDEMLSQISLLLNI

SEQ ID NO: 1146 - protein, 450 aa, Lagenaria siceraria
MDAQQAGSNTPTPTTILMLPWLGYGHVSAYFELAKALSSRNNFHIYLCSTPVNLDFIKSKLIPSSSSFIQFVELHLPSSPEFPPHVHTTNALPVHLTPTLHQAFDAAAPRFEAILQTLSPHLLIYDYFQSWAPRLASSLNIPAINFNTSGTSMICHGFHSIHYPNSKFPVSDFVLHNHWKAKFNSALSEHARSVKEAFFYCFNASCDVILTNSFREVDGKYMDYLSLLLKKKVIPIGPLVYKPNEEEEDEDYWRIKNWLDKKEALSTVLVSFGSESYASEEEKEEVGNGLEESETNFIWVERVSLKEDQEQERRGFVERAGERALVLKGWAPQGKILKHGSIGGFVSHCGWNSVLESIVSGVPIIGVPISGDQPFNVGVVEEAGVGVEAKRDPNGKIQRQEVAKLIKQVVVEKTREELRMKVREMSEILRKKRDEKIDEMLAQISLLCNI

SEQ ID NO: 1147 - protein, 450 aa, Cucumis melo
MDAHQASDPTTTTILMFPWLRYGHLSAYLELSKALSSRKNFLIYFCSTPVNLDSIKPKLIPSPSIQFVELHLPSSPEFPPHLHTTKALPLHLTPALHQAFAAAAPLFETILKTLSPHLLIYDCFQSWAPRLASSLNIPAINFNTSGASIISYAFHSIHRPGSKFPISDFVLHNHWNSKYNSTLREHAHCVKEAFFECLNTSRDVILTNSFKEVEGEYMDYISLLSKKKVIPVGPLVYEPNEKDEEDEDYSRIKNWLDKKEALSTVLVSLGSESYASEEEKEEIVKGLVESGANFIWVERINQKGDEEQQIKRRELLEKGGERAMVVKGWAPQGKILKHGSIGGFVSHCGWNSVLESTVSGVPIIGVPLFGDQPFNAGVVEEAGIGVEAKRDHDGKIQRQEVAKLIKEVVVEKSREEIRMRVREMSEIVKRRGDEKIEELLTQISRLSNIS

SEQ ID NO: 1148 - protein, 480 aa, Cucumis melo
MATEGRQLHIFMFPFMAHGHMIPIVNMAKLFASRGIKITIVTTPLNSISISRSLHNDSNSLDIHLLILKFPSAEVGLPPDCENVDSLPTMDLLPIFYQAINLLQPSLEEALHQNRPHCLVADMFFPWTNDVADRIGIPRLIFHGTGSFSLCASEFVRLHQPYKHVSSDTEHFLIPYLPGDIKLTKMQLPIILRENVENEYSKFITKVKESESYCYGVVVNSFYELEAEYVDCYRNVLGRKAWPIGPLSLWNNETEQISQRGTGSTIDEHECLKWLDLQKPNSVVYICFGSLAKFNSAQLKEIAIGVEASGKKFIWVVRKGKGEEEEDEQNWLPKGYEQRMEGRGLIIRGWAPQVLILDHLAVGGFVTHCGWNSTLEGVVAGLPMVTWPVAAEQFYNEKLLTEVLKIGVGVGVQKWAPGVGDFIKSEVVEKAIKRIMEEEGEEMRNRAIEFAKKAERAIEKDGSSYLNLDALIEELKSLAF

SEQ ID NO: 1149 - protein, 450 aa, Momordica charantia
MDARQQAEHTTTILMLPWVGYGHLSAYLELAKALSRRNFHIYYCSTPVNIESIKPKLTIPCSSIQFVELHLPFSDDLPPNLHTTNGLPSHLMPALHQAFSAAAPLFEAILQTLCPHLLIYDSLQPWAPQIASSLKIPALNFNTTGVSVIARALHTIHHPDSKFPLSEIVLHNYWKATHATADGANPEKFRRDLEALLCCLHSSCNAILINTFRELEGEYIDYLSLLLNKKVTPIGPLVYEPNQDEEQDEEYRSIKNWLDKKEPYSTIFVSFGSEYFPSNEEMEEIARGLEESGANFIWVVRFHKLENGNGITEEGLLERAGERGMVIQGWAPQARILRHGSIGGFVSHCGWNSVMESIICGVPVIGVPMGLDQPYNAGLVEEAGVGVEAKRDPDGKIQRHEVSKLIKQVVVEKTRDDVRKKVAQMSEILRRKGDEKIDEMVALISLLLKG

What is claimed is:

1. A method of producing Compound 1 having the structure of:

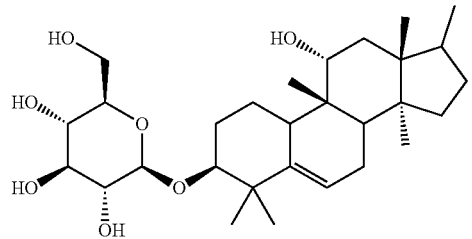

(1)

the method comprising:
   contacting mogroside III$_E$ with a recombinant host cell that comprises a first enzyme capable of catalyzing a production of Compound 1 from mogroside III$_E$, wherein the recombinant host cell comprises:
   (1) a cytochrome P450 that comprises an amino acid sequence having at least 90% sequence identity to SEQ ID NO: 1025; and/or
   (2) a cytochrome P450 that is encoded by a nucleic acid sequence having at least 90% sequence identity to SEQ ID NO: 1024; and/or
   (3) a glycosylating enzyme that comprises an amino acid sequence having at least 90% sequence identity to SEQ ID NO: 1051; and/or
   (4) a glycosylating enzyme that is encoded a nucleic acid sequence having at least 90% sequence identity to SEQ ID NO: 1050; and/or
   (5) an epoxide hydrolase that comprises an amino acid sequence having at least 90% sequence identity to the sequence of SEQ ID NO: 1073; and/or

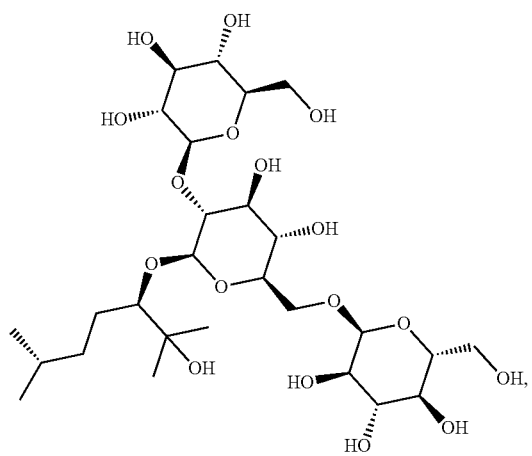

(6) an epoxide hydrolase that is encoded by a nucleic acid sequence having at least 90% sequence identify to the sequence of SEQ ID NO: 1072.

2. The method of claim 1, wherein the recombinant host cell comprises a first gene encoding the first enzyme.

3. The method of claim 1, wherein the mogroside III$_E$ is present in and/or produced by the recombinant host cell.

4. The method of claim 1, comprising cultivating the recombinant host cell in a culture medium under conditions in which the first enzyme is expressed.

5. The method of claim 1, wherein the first enzyme is one or more of UDP glycosyltransferases, cyclomaltodextrin glucanotransferases (CGTases), glycotransferases, dextransucrases, cellulases, β-glucosidases, amylases, transglucosidases, pectinases, and dextranases.

6. The method of claim 1, comprising contacting mogroside IIA with the recombinant host cell to produce mogroside III$_E$, wherein the recombinant cell comprises a second enzyme capable of catalyzing a production of mogroside IIIE from mogroside IIA.

7. The method of claim 1, comprising contacting mogrol with the recombinant host cell, wherein the recombinant host cell comprises one or more enzymes capable of catalyzing a production of mogroside IIE and/or IIIE from mogrol.

8. The method of claim 1, comprising contacting mogroside IA1 with the recombinant host cell, wherein the recombinant host cell comprises a gene encoding UGT98 or UGT SK98 enzyme comprises an amino acid sequence having at least 90% sequence identity to SEQ ID NO: 9, 407, 16, or 306.

9. The method of claim 1, wherein the method comprises contacting 11-hydroxy-24,25 epoxy cucurbitadienol with the recombinant host cell, wherein the recombinant host cell comprises a third gene encoding an epoxide hydrolase.

10. The method of claim 1, wherein the method comprises contacting 11-hydroxy-cucurbitadienol with the recombinant host cell, wherein the recombinant host cell comprises a fourth gene encoding a cytochrome P450 or an epoxide hydrolase.

11. The method of claim 1, wherein the method comprises contacting 3, 24, 25-trihydroxy cucurbitadienol with the recombinant host cell, wherein the recombinant host cell comprises a fifth gene encoding a cytochrome P450.

12. The method of claim 1, wherein the method comprises contacting cucurbitadienol with the recombinant host cell.

13. The method of claim 1, wherein the method comprises contacting one or more of 2, 3-oxidosqualene, dioxidosqualene and diepoxysqualene with the recombinant host cell, wherein the recombinant host cell comprises a seventh gene encoding a polypeptide having cucurbitadienol synthase activity.

14. A recombinant cell comprising: Compound 1 having the structure:

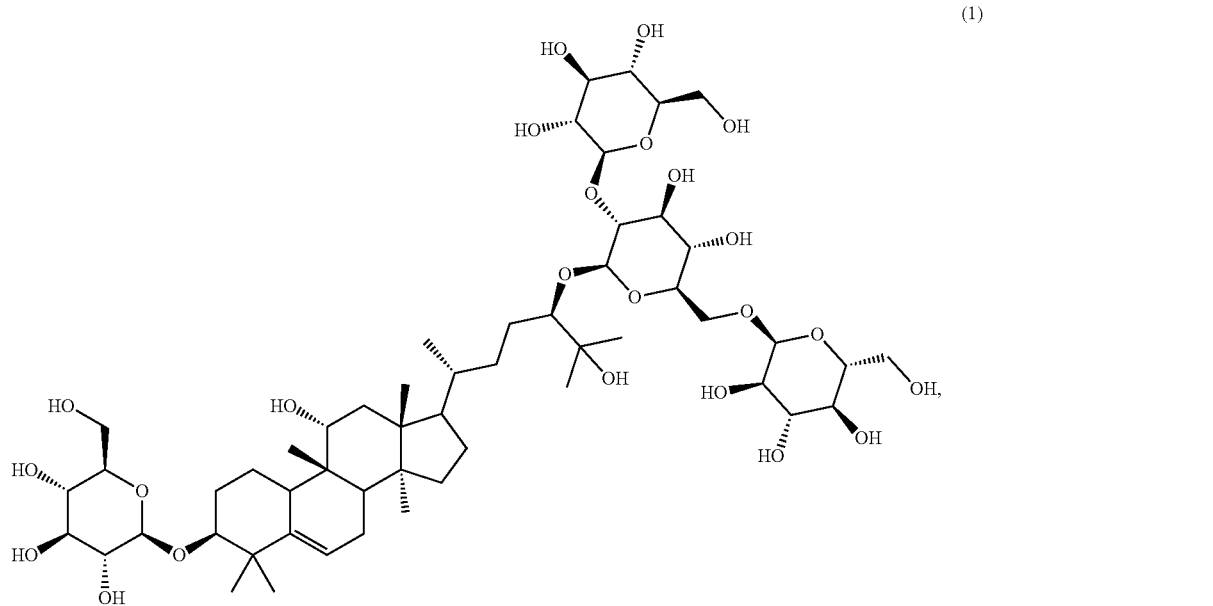 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]
(1)

a gene encoding an enzyme capable of catalyzing production of Compound 1 from mogroside IIIE, and one or more of
(1) a cytochrome P450 that comprises an amino acid sequence having at least 90% sequence identity to SEQ ID NO: 1025; and/or
(2) a cytochrome P450 that is encoded by a nucleic acid sequence having at least 90% sequence identity to SEQ ID NO: 1024; and/or
(3) a glycosylating enzyme that comprises an amino acid sequence having at least 90% sequence identity to SEQ ID NO: 1051; and/or
(4) a glycosylating enzyme that is encoded a nucleic acid sequence having at least 90% sequence identity to SEQ ID NO: 1050; and/or
(5) an epoxide hydrolase that comprises an amino acid sequence having at least 90% sequence identity to the sequence of SEQ ID NO: 1073; and/or
(6) an epoxide hydrolase that is encoded by a nucleic acid sequence having at least 90% sequence identify to the sequence of SEQ ID NO: 1072.

15. A recombinant cell comprising a first gene encoding a first enzyme capable of catalyzing production of Compound 1 having the structure:

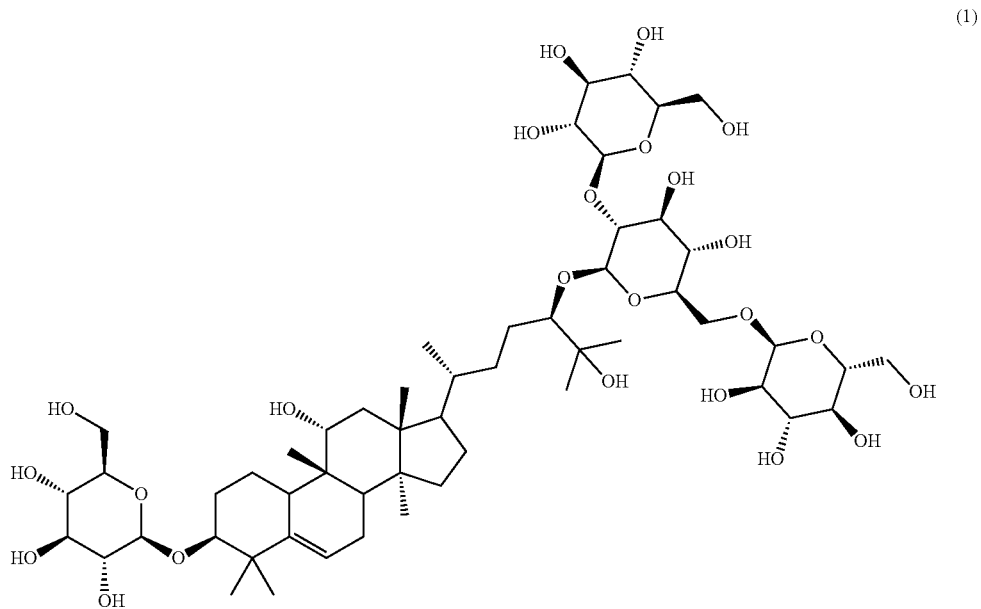 [SMILES: C[C@H](CC[C@@H](O[C@@H]1O[C@H](CO[C@H]2O[C@H](CO)[C@@H](O)[C@H](O)[C@H]2O)[C@@H](O)[C@H](O)[C@H]1O[C@@H]1O[C@H](CO)[C@@H](O)[C@H](O)[C@H]1O)C(C)(C)O)C1CC[C@@]2(C)C3CC=C4C(CC[C@H](O[C@@H]5O[C@H](CO)[C@@H](O)[C@H](O)[C@H]5O)C4(C)C)[C@]3(C)[C@H](O)C[C@]12C]
(1)

from mogroside IIIE, and one or more of
- (1) a cytochrome P450 that comprises an amino acid sequence having at least 90% sequence identity to SEQ ID NO: 1025; and/or
- (2) a cytochrome P450 that is encoded by a nucleic acid sequence having at least 90% sequence identity to SEQ ID NO: 1024; and/or
- (3) a glycosylating enzyme that comprises an amino acid sequence having at least 90% sequence identity to SEQ ID NO: 1051; and/or
- (4) a glycosylating enzyme that is encoded a nucleic acid sequence having at least 90% sequence identity to SEQ ID NO: 1050; and/or
- (5) an epoxide hydrolase that comprises an amino acid sequence having at least 90% sequence identity to the sequence of SEQ ID NO: 1073; and/or
- (6) an epoxide hydrolase that is encoded by a nucleic acid sequence having at least 90% sequence identify to the sequence of SEQ ID NO: 1072.

16. The method of claim 5, wherein the CGTase comprises an amino acid sequence having at least 90% sequence identity to the sequence of any one of SEQ ID NOs: 1, 3, 78-82, 85-87, 89-92, 95, 98, 101, and 154.

17. The method of claim 5, wherein the dextransucrase comprises an amino acid sequence having at least 90% sequence identity to any one of the sequences set forth in SEQ ID NOs: 103, 106-109, 156, and 896.

18. The method of claim 5, wherein the transglucosidase comprises an amino acid sequence having at least 90% sequence identity to the sequence of any one of SEQ ID NOs: 163-291 and 723.

19. The method of claim 5, wherein the beta-glucosidase comprises an amino acid sequence having at least 90% sequence identity to the sequence set forth in any one of SEQ ID NOs: 102, 292, 354-374, and 678-741.

20. The method of claim 6, wherein the second enzyme is one or more of uridine diphosphate-glucosyl transferase (UGT), CGTases, glycotransferases, dextransucrases, cellulases, β-glucosidases, amylases, transglucosidases, pectinases, and dextranases.

* * * * *